United States Patent 12,577,609 (METHODS FOR CELL-TYPE SPECIFIC PROFILING TO IDENTIFY DRUG TARGETS) - sequence listing, part 17

SEQ ID NO: 23300 - DNA, 9091 bp, Homo sapiens
  ENST00000637045
agagcagaatgtaatttctagcaatctgacagacctgcggattgaagcggcaggttttcccttccgatttcagggaattgcttcttactgtgacaaatgattagctgttatctctgactgaatttgatttctacaagcagctgagtcagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23301 - DNA, 9115 bp, Homo sapiens
  ENST00000636820
agaatgagatgagaacctatggtaggtggaggtgaaaaatgaaatgcgtcagggaagatcatgactgggaccgccgcacactgcagtgatgaagacggagaagctattcttcagggaacctgcaaataaaaagaaaccttaagatgtatttggagggaacccaccccagcaagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23302 - DNA, 8984 bp, Homo sapiens
  ENST00000636179
agaactagaagacgatacggagctgttagtgtgcatattcagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23303 - DNA, 9158 bp, Homo sapiens
  ENST00000637304
aaacaagcgaacgagcgccagcccagactcggaaaggaaacttctcgctcccctcgctctcagcccgatcacccggcgcggggccgcgtagacgctcccgaggcaggcgctgggacgcagcgcccacccggcctcccggcctccgcagccccagcccgcgcctcgcggggaccgcccgggcccacttggagcaactttcctctagagaagacaatttggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23304 - DNA, 8932 bp, Homo sapiens
  ENST00000638128
gggacgcggggggacagagagaaacagagagagaggaagagagtgagagagagaccccctagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23305 - DNA, 9583 bp, Homo sapiens
  ENST00000636471
gagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtgattcttctcttggtagacaattgcaattgttatctaatcaaggaaatgtaacggtaattttaattatcattttaggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23306 - DNA, 9541 bp, Homo sapiens
  ENST00000627532
tggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataacagaaataaatccttcagtcttcatttgtatctgaaatgtggaattagtcagagaaatggcaccgagataatatgatgctgaatatgccacaagctaaaactttctctattaaacgagtcgcctactacctataatctagcatgacatgttaaaatgctccaaaatactgaaaatagaaaatgaacactactgttccgatttggtcttgagattaatatgacaaagattctaataattttagtcaaagaaaatgatgagtaaaaaatacatgaagattaaagtgatgacaaatga

SEQ ID NO: 23307 - DNA, 1755 bp, Homo sapiens
  ENST00000419938
caggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaa

SEQ ID NO: 23308 - DNA, 5361 bp, Homo sapiens
  ENST00000409487
agaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacaatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaact

SEQ ID NO: 23309 - DNA, 5073 bp, Homo sapiens
  ENST00000636732
gaggcacagcatcttcccaacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaatcttccttgttcctgtgcttggcatgcttagtatagtaagcctttctacaattctcaaatgctaaagataattttcccccacagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacat

SEQ ID NO: 23310 - DNA, 5172 bp, Homo sapiens
  ENST00000636026
aggtggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaa

SEQ ID NO: 23311 - DNA, 4061 bp, Homo sapiens
  ENST00000539609
agttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttca

SEQ ID NO: 23312 - DNA, 4012 bp, Homo sapiens
  ENST00000558170
cgaagtttcgctttggcgttggggggcgcggatgggtgctcgccggggccctggcccggctcccctgggcggcccgcgcgcgtttcaatgggcgcgggcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttgga

SEQ ID NO: 23313 - DNA, 3913 bp, Homo sapiens
  ENST00000303660
acttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcg

SEQ ID NO: 23314 - DNA, 100 bp, Homo sapiens
  ENST00000637873
gacattccagaaaagcagttcccttctgcgacataaatacgaacacacagactcctatgactgataagacagtcttgacatcctctttcctctgtttctt

SEQ ID NO: 23315 - DNA, 2236 bp, Homo sapiens
  ENST00000427902
ttactgtaccgccgtgtgcattccctcatacggtcaggagttatgactcattttgaagatatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaatt

SEQ ID NO: 23316 - DNA, 2677 bp, Homo sapiens
  ENST00000637267
ccccatgccgtttaatatcatgctctcccttccctgctaagtttctctatggcctttctcgtttctcctcctgcctccctacacactctcccttactttgtagtgaggtctccccgaggtgtagagagattcagagatcggccaaccgagtgttctattttaatttacttagagaccctttattaaaatgccaaactactttttaatattgggatccagtccagaaattcatcatgcacacaccctaatacacatgccctaagatgcagctcccatgcagcatttttttttctggctctggtacctaaaaagaaaaaaataacaataagagaaagggcagagaactttgttccagaagctgtactgagatacctacacaatttgatgtgcatctcaaatctggtcattagagatatctgtataagaagagactatctggattgaggacccgggatctttccctttaactttcgccccttggagttctccagttctgtgaatgaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcg

SEQ ID NO: 23317 - DNA, 1514 bp, Homo sapiens
  ENST00000392861
atcatttagtagagcttaaaagtattgccgtagtggttggactttctctttcctttcttaagggaaaaaaaaaattctactggaactatttaagggaaccagtgtgggggagcatgtgtgtgagtgagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcactta

SEQ ID NO: 23318 - DNA, 674 bp, Homo sapiens
  ENST00000497268
tatctttaatgtttatggatcttagaatgcagttgttggctttttaaaaaaaatttatgaaaaacattttaaatttctttcattctttgtatatacagactaatattccaggaagaaaaaataaaataaaatgtgcttatttaacttgaaggaaagtgcccgccttcttgcatatattgcaagaataagcattcagtcaataatcggtcatcttcaacacttcttacaaataaactaggttttgtagtctattgcaagtcagcatttctcactggctatgatggagatggacttgggatcctaggaagaaggcccggaaacaacatttcttctccttttatgatttcagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctg

SEQ ID NO: 23319 - DNA, 709 bp, Homo sapiens
  ENST00000431672
gggccctggcccggctcccctgggcggcccgcgcgcgtttcaatgggcgcgggcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgccc

SEQ ID NO: 23320 - DNA, 587 bp, Homo sapiens
  ENST00000409211
atagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagtgaagaatgcaaattgcacatcagatttt

SEQ ID NO: 23321 - DNA, 1071 bp, Homo sapiens
  ENST00000465308
agacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatc

SEQ ID NO: 23322 - DNA, 583 bp, Homo sapiens
  ENST00000434448
aacctccaccgagttttcaggattctcctcctctcctgcctgcctccgaggtcccccttctccaagttttgacagtttcaactgaaaaaatgcagcgcctctctcgatttttagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgggtcatcaagattgtcagaaaaggcctggactacatgcctgtcccagcactagattgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaagg

SEQ ID NO: 23323 - DNA, 3837 bp, Homo sapiens
  ENST00000472146
agttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccaggtaagtgtctaaaatcacttggcctcttcctgtaccatcttcacatcttcaactaatctgttccacctagcagatcgcccacaaccaaataattaaaatatttctttccattgagcccttgcagaatagagataccaaagctggtgacagattatgaagtgatagtaatgttatcacattgcggcagttacatcttaggaagggattatatttcagttttgatgcaagtcaaacatgaaccacactttcaacacataacatgaggtatttgcaccacatttacaatgtgcaaattatgtaacatgatcaagatctatactttcatgataggaaatggaagcaaatgtaaaaactcacaacatatatatgtatataaaaatattttgtgtggaaattatgtagcatttcaaaccaaataactgtcagtttaatgtagcttcagtgtctgtctgacacctcctattggaattcaatcgtttaatgattcccttttgttaagtgtgaatgtgatttcacacttttacctggtcaggtagctttcttattatttatcagctaagtacttgataatgattcctgctgtttggtgggactctcaagggaagtaaaaatggtcccaggccaactataataaaactaaggtaaattatattcaaactaaaacttccgacaacactgtgcaaacgggaaatgtcttggtctaaaattcacttatgacggagaatcgctaaggtatgaaatgtttaacaaaatacaagaaatcttattcctgtgaactttctctgctcatctttacatggtaaagtggcctggaaaatttgtttaaatgacctctctaattcagacctcatgtcaccttcatctctattcccaggacccactgagagttatcattgtttaccccaccttgttttttctttgacaacataagcaacaaaagcatttttataaataggtgaagtggctgggaaggagtctacctatatgctgttgtgatgtcgcagactataaaccatcaaacataggcagaataattgtttggtatactggaaggaggataataaaagcacttccactacgaaagaaaattaaatgtgagatgaaagaaaaagaaaaaagactgatggcaatttgagtacagtgtatttgtttttcgttttcctaacatactgtgccaagttttctactctttccgtttccaattttgctttcggtgaaggtttctcgaatctcagcaatcccacacataaacatttatcgttatatccattaagccttaaggttttagattttcaactatgagggagaactcagccaaagatgcttgaaagataaatacgtttaattaggggcagaggatgatcattaaaggaagtctgactgctgcagaagtcattaacaatcttaaatgaaatttttatttttatgatagccatttacatgtataataagagccaatgattcttgggagcagtgtgacagaaacagagtgtggcgagaactcatgtaagacatactatttaaatgagctggtgttagctattcatatttgttaatgaactagatatgcagggctataagaatgaatgttctgatgctttaaattttaatatctagaaatcaagggtaaggaccaattactagaatttccacccttagaagaataattaataacaatgtaacaaatgtacagccccaaacctcttttaaaaaagtttaatttaaaaaatttaatatcaatagttgaaaaacagccaaacagcaatgtcaagctgtagtagtttgtgattgtggcagctttttgtgttggtcatggatcataattctaaacgttttaatatacagtaatccatatgaatgcattgcagaccctgttatcacctgtagttaatggtgcctgtgatacaagtgaacaggctgttctttgctcttacctttatggtaaataaaccagcattctggagtcacaataattaaataaaatgtaaatccctaatctcatttggctatttggaccaagaaacttacccggctattacctgtctagttctaatgattactaatgatttattgttctttttttttattgttctaaaagtgctctgatgtggtgccttgatgtctaatgaaaagaaattggtcttaaaaagctactcattgtttatcctgactctgagataacacatttttcttctgataaaatatttttcttatttattgttcaaaacacacaatatagacaataactctaattctggtgcagttttatttagtagtgttttatccccggtgcctggctgtctacagtcatacctcagcacatagctttactctgagataagccctctctcctttgctctttctcccatgctttctggagtttgtctgcaggatgcaggttttgaactgaagagcgcagtggagttcttactgtgcctttccggttccagcacaatcaaagttttgtgtttggaattgtccttgacattctttcgtcccacaatggggtggacacagtgtgctggaaaccatgacatcattatcattgacacagacttaaataaatcacctgcatcttggcctctttctgcttattcaaggattcttcatcttaaggaagaaagtgctctttatttttacaaatcttcatcccaggggtgactggaagacgcaaacttttacaagtgttttaaaaataaatatactatgtggttttagacacagtatgctgagtcagaggtgtcttagagaatgtttaaggttagacataaggcagaaagacagccagattgcctttaattcggaggcaatattcctaaactgtgtatcattatgtccttctgaatatggattcacttgaaacttaattaaataggcatatacataacatttcaaatacatacctgaaaaggcttagtagtgtttcattttcacacattgagcttgatattcaaaaaagaaaaagattgatgctcagtgaatcaaagcaaagtactttctaggtaaaagtgacaccatctcatccaatgtctctgaaagatctcagttgcacagtctttggataaaaagggttataactaaataatactacaaaatgcaatttacacaatgtgctgactacacatttgtatacccagcatttattaatttgggaagcaaccaactactgtaacttctctttactttttcataagaaaatgacaatgaggaaggaagtgcagcagaaatcttgaacattaccactattatgcaaaaa

SEQ ID NO: 23324 - DNA, 751 bp, Homo sapiens
  ENST00000461784
ggccgccgaagtttcgctttggcgttggggggcgcggatgggtgctcgccggggccctggcccggctcccctgggcggcccgcgcgcgtttcaatgggcgcgggcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccaggtaagtgtctaaaatcacttggcctcttcctgtaccatcttcacatcttcaactaatctgttccacctagcagatcgcccacaaccaaataattaaaatatttctttccattgagcccttgcagaatagagataccaaagctggtgacagattatgaagtgatagtaatgttatcacattgcggcagttacatcttaggaagggattatattt

SEQ ID NO: 23325 - DNA, 601 bp, Homo sapiens
  ENST00000476394
atttcttccactaaagcgtttgcggagacttcaagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccaggtaagtgtctaaaatcacttggcctcttcctgtaccatcttcacatcttcaactaatctgttccacctagcagatcgcccacaaccaaataattaaaatatttctttccattgagcccttgcagaatagagataccaaagctggtgacagattatgaagtgatagt

SEQ ID NO: 23326 - DNA, 543 bp, Homo sapiens
  ENST00000479735
gcttctcggtgcgccaagtaacggtccgcgggcagcggggcccggcccatcgcgcccagaccccggggtgggagggagtcggccggccccgcgcggggtccggtggggtcgatgatggctcggggacggatgactcctctccagcaggctctgcccccaggccggggactgaaggagtcgcagggcgcagcgagacttttcccggcagtttctacatggtctggaggagcccgttatccaggctgagtcaggaaggaggaaggagaaaggagatgggggttcgaggggcacacgcagatcagagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaa

SEQ ID NO: 23327 - DNA, 554 bp, Homo sapiens
  ENST00000435831
gtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacgatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtg

SEQ ID NO: 23328 - DNA, 581 bp, Homo sapiens
  ENST00000453352
agttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgggtcatcaagattgtcagaaaaggcctggactacatgcctgtcccagcactagattgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtg

SEQ ID NO: 23329 - DNA, 577 bp, Homo sapiens
  ENST00000444559
ggaggtggaatttcatttcttccactaaagcgtttgcggagacttcaagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagct

SEQ ID NO: 23330 - DNA, 468 bp, Homo sapiens
  ENST00000630572
gggaaatcttaatttgggggcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaaggatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatg

SEQ ID NO: 23331 - DNA, 2967 bp, Homo sapiens
  ENST00000628473
atcgagctacaaggttctagactaagtaagtgttttgtatacatattagctccatattacctccatgacctctttccccatgaagccttccctgagcctcagtatccactctttcctgtaccatgaatccatttttcttttactttttcttttctttctttcttttctctctctctcgcttgctctttctttctttctctctctgtctttctttttttgttttttgttttttgttttttgttttttgagacagggtctcactctggcacccaggctggagtgcagtggcacaatcatggttcactgcagccttgacctcacaggctcaaaccatcctcctgcattagcctcccaagtagcttggaccacaggcatgcaccaccatgcccagataatttttttttttattttttgtagagacggggtctcactatgtcacccaaactggtcttgaattcctgggctcaagtgattctcccacctcagcctcccaaagtgctgggattacaagtgtgagccactgcacccagcccatgttttcaataaagatggtgctatttgaaactatggcatgtcacgtgtatattattttatttcaccatgtgtttaaatgagataaccaggtgccaagaaagcttcaatatttgcttaaatagccaatgtgacggagaataggtaacctcttttctttttttttcttatgatttgctttggctattagttttgaaacatacatgttatattcccaattagatctcgttacatccttcacaggctgtccaaaaatttccatacttctaacaagaacttcggttgactgagtttatattatatagtttttctgtcctttgccctatttctttcaaggcctttgagtcagaagcattcagcaccacggcgtacgatagccaccatttgctttgcccttttaactttgggggttacttctgaccatagtccaactgctcagaagggctttttcacaaattgtttaccgtggcagttgctaccctattggggtttgcattcagaacccataagcagagagcaatggtgtcagtataacaaataatgtgtacaattttttaaaatgctgaatttaccaaatccccatattatgttttcacactgctctttcagaaactgtgctaatacaatactcctataaactgatcttggtcctggcaggccctgttggaactaatggggcctgacagttcttcagttaaaaattatacatgagggccactttcccttaaattatctattgtatgccagctgttcacaactgcactgcttcactttctttgcagtgctagaaatgtctaattttctcataatatccatagcaactattctcatggagggcattgaagttagtaagacttcaaacacaccttcacagaaatcatgctagagttgcagtttccattttctttaattttttggttctgaaaaatgtttagatggctcattttgccggtttcatgccatagcacttgagttatatcataatttctcatttgctgcacaactttattctatttttatgctcctaaatgacgcagctctaagtacccgtgagtggcacttccgtgctgtgagtgctatcaaaggcaacctcagatggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtggtggtaggccctgtaatagctagcgtaggaagggtggtgaaaattgatatgcactattactacacgtataaaacttaacactggggccattgcacaggtggggggttcctgtttattgatttttatgagtttgttagaacatgcgcttaatgcttttatactccgggagctctgggagggctcaccttaggtaataaacctttccgtactttgcaatcgctcacaatttacatggggactcacattatccagtacaaagcccagcattccccttctacttggttttaggagtgtgat

SEQ ID NO: 23332 - DNA, 845 bp, Homo sapiens
  ENST00000484313
gcgggtgcaacacaccaaacaatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgcaaagacaaaccacctaaatagagagattaattccacatcagtgcaacattaaaagggagagaggatgccaagaatcccattaatttgggatataagtgtctgaaatttcctcaaaacatttacgccaaggaataccaacaagacaatatcaagcagctctccctaaggatagagaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaa

SEQ ID NO: 23333 - DNA, 101 bp, Homo sapiens
  ENST00000637591
gcgcaaacaagccaatcccaggaggaaaaacgactgactttaaaacaaaggcagaacatttattacaaatatcactgtgtgaaaggaaatctactgaaata

SEQ ID NO: 23334 - DNA, 1435 bp, Homo sapiens
  ENST00000629955
gcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacgatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgaggttaccttttcccgatggtgcaaaatcgacttgacataactgttcatcagtttcagggttttccctggaggtatttgcatcaaatcagcccagtcaagcttcaagttgaaattggcaggccagaaactcacagggtagagactggaaaagagacagccaaagtacaggcagcaaactgacagcagcagagtgaaagacagaggggtggggggaggttgagagcgagagcttttcaactttagtgtgcgggaaatctcagctcctcctgtactgatctcagcagcaccatatcctgaaggagcttgaaaggttgagattcagaacaccttcagctaattcttaccactagggctcaccagccttgctccgggggtttgctctcacttaatctgattggatgcctaaagaggagtgggcacacttaattaaacggaaggaaagttctgaggcacctccccagcacttattaaagcttgaaagccaaatctcatgatcagtgttataggaggaaattaaggtggtttgttttttttgttgtttttttttttttttctaattgttaacttgtaggaaagtgaacaatccctctctttaccaggtttgttttcttgggggttctcttctgagtagattaaatgttcacagagactagagctcaggggactgtccattcaaaagctaatgcattttggctaacaaaaagccagtacaagtagcaaaaattatatttgaagagatactcctttgaatgacatgggtttgcaagttctctgtcaaataatgccctactatcctggtaatatgagaacacgtattaagttgtttaaaaggtcaaaaaacatggcaaaaccttaagatgtctaagatactcaacttttactctcaacaaggtcactttaagaaaaattctatgattgcaaaacttgtataattgcttttacaaagaaaacaaatatgaaaagtgtttcct

SEQ ID NO: 23335 - DNA, 2949 bp, Homo sapiens
  ENST00000465070
ctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtg

SEQ ID NO: 23336 - DNA, 2648 bp, Homo sapiens
  ENST00000470879
gaaggaaagggtccgcctagccctgagtcaagcggtcttactgtaccgccgtgtgcattccctcatacggtcaggagttatgactcattttgaagatatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaa

SEQ ID NO: 23337 - DNA, 2564 bp, Homo sapiens
  ENST00000629520
cggagacttcaagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaa

SEQ ID NO: 23338 - DNA, 2947 bp, Homo sapiens
  ENST00000636445
ttccactaaagcgtttgcggagacttcaagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtttctacatggtctggaggagcccgttatccaggctgagtcaggaaggaggaaggagaaaggagatgggggttcgaggggcacacgcagatcagagccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaa

SEQ ID NO: 23339 - DNA, 3061 bp, Homo sapiens
  ENST00000625161
caaaatcatatagaaattcctggaaagaaataatggcaataataatcgtataagtagaagctggaagggaaaaaaagatggtcatccaggaacctagaatggcactttatataattttaatgaagtcaacagtgtatatatagactaaggcgacaaggagataaaacgtgtaaagcagtgtgtgtgttttaaaggctggtcaagaacgtgagttagaagacaatgctatgtacatttaataaaaagcaaaggagaaggaggcagttgaagaaaaataaatgtacaaagagagaaacaagtatctgaaatacaaccttccagattctcaggctagcaagatgcctggcagaggcagtgccagggccaagttaacccatagcgggcagtcagtctcctttcccccacatggaaaggatgaaatctcttcccagaaaataagatgtgcaggaggaaagagggagtggggtgagggggaaggaggcaaaaagcgagttgcccgcagacaagaatgtgtgtcggtttcaagaaagttcagtcagatgatcctcagtcgcctgactcactttgtaacactttcactgacgctggagaggagggggaaaacccagcccccctttttctttcccctgattataccccactatctccacacagccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcatttt

SEQ ID NO: 23340 - DNA, 656 bp, Homo sapiens
  ENST00000462355
aaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacaatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagttt

SEQ ID NO: 23341 - DNA, 536 bp, Homo sapiens
  ENST00000475115
ccccccccgctccccgccccccaagccttagtgagattgacagtcgcgtggaggaggcttttccaggcacagcctttctcatggtaatcagcccccggcatcacctcccggccgcggctgcgcccgctcggagcgcggctcgcggaccccggggaccggaaacagggcggcgggcggggagcaggcgagcgagccagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatca

SEQ ID NO: 23342 - DNA, 1809 bp, Homo sapiens
  ENST00000440875
atttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaaactcaaggagacagtggctcatgcctgtaatcccagcactttgggaggccaacgagggtggatcaggtcaggagtttgagaccagcctggccaacatggtaaaacaccatctgtcctaa

SEQ ID NO: 23343 - DNA, 968 bp, Homo sapiens
  ENST00000401903
agatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgctcacccatgacagtctctgaatccaggccgttgggagatttcctcaccctggctcctggcgggctggcccagcgactcgggtactggttcacccggctcatgtgaacgcaatttcgtctgtgtggggtgctgcagctcttggttggtgaacacggaaaggttgctgtgtgtaactgcacagtgtgacgcgatgctccagtggtgcgacttcgtcaggatggatgaaggacacaggactgggaccccaagttacagaagcagctcgctcca

SEQ ID NO: 23344 - DNA, 852 bp, Homo sapiens
  ENST00000397083
ccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagtcactttgctctcttagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 23345 - DNA, 860 bp, Homo sapiens
  ENST00000316495
agatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 23346 - DNA, 542 bp, Homo sapiens
  ENST00000471448
gtttaagtgtgccgcacaggagtactcgtttaaaacttctgtgagtttaagttgcatgagtctcagatgccatcttacctttgttatttttaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttg

SEQ ID NO: 23347 - DNA, 433 bp, Homo sapiens
  ENST00000574135
gtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttg

SEQ ID NO: 23348 - DNA, 1084 bp, Homo sapiens
  ENST00000484977
gtcggggcgcgcccggaaaccccaaggcccagacggctctcagatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggtaattgatcctttgttcaaaagattctcatcttcaccgtctgaagctgcactgtcttgctggtatggtagggactagcgacgtatggctaactcattgaaaattaaattttaaaatccagtttttcagtcccactagcctcgtttcaggtgcctgctgttaggcagtacagaggagcgtgtctgccctcacaggacattctgttggatgactctcagacaactgagatcttattttcagggactcatggagtcacttagttgtaaccttatgttccaagcttactttagatgttcaaatacttggttcctttgatctgttacaccatagctgttacaccatagctgtgtcttcaccagatgcaagaaagattttaatatttgacttggaagccaatcaggaaggcagtaaatacgcttattgatttgaataactgcagccttgacatagtatttaggtgactcccagagtacacagcagaaactgaaagaggacctaaggaaatgagcttgccccgagtccagaggtttgagacttgttgttgacttttcagatggttcccagcccgtgtttactttgtctctggatgggtcacaggtcattttagtgaactctgccacttgaccgtggtgg

SEQ ID NO: 23349 - DNA, 557 bp, Homo sapiens
  ENST00000478137
acgcggccacataaccgtccagggggcggggggcagcgcggtgaaatggaaaaggatttaactgggggatctaggtgctggggacactgacattttcggaccccggccgcagccctgagtcagcttccccgctcctcgcccgcccggctgcgcctgcgcggagccgcctcactgtgacccagcaagcgcgccgcctgcgagaagcgaccggacacttcgagaagggaagtggagaagcgaggagtgggcgggcctgcggggcgcggcggggcgggattggccggatggctggtgtcgtcttcggtgtgcgccggcgccactgggccgcggcctggcgggattggccggtctgcgggtgacgttgtcggggcgcgcccggaaaccccaaggcccagacggctctcagatccgggggctgcggataaatccccgtaggccgcgggcagcgagatgttgcgttccggtgtgggtgtgggtgtgcctccgacggcgtctcggtgccagtgtcgaggttctttctgcttagctacccggagccgactacggaggaggacacc

SEQ ID NO: 23350 - DNA, 3020 bp, Homo sapiens
  ENST00000488164
gcggccgcgccccctgcccgttgcagccccccctagctctcccctaagaggagccgttcggggtcgggggtcgggggtcggggatccgcgtggggcctgcaggcgaagggctggccgggcctgctgagctgctgttctgcatgactcagtggttttcggagagggccctgttgggctttattgagtgaggcctttgcttagagggggatggggtatcagtgggacccgaacttgttccaaaatccattggaacatggggccgggggttctcggcgtcgtcttttgggcttctcgacgtcgctgcgtttttatcctgagatccgttttcatggaggaaatggaacacctcctttgtttggtgcatttaggctgatgaatgtgaaattttttgctcgctttccacgcactccgtggaggtgtgttttcggggaagggtcggattatctttattgattgagtgtctcctaagggatagcatctaaggagataccaagataaaggaacatataggtcacacatccccgttcttaaacctgggatttagatacagacttctaaaaacataaacgaatgtattttattccttatttttaggattttttttaaagagtaggctttcagaactcagttggtgaaaatactgcaattttatctttgaagttttttgttaaaatgtttccccacacccccctaaaaaattaaggattctttgtagttgtctcctgttttctatctcccaggccctgaaaaggagcctttaaaagtcaattctactccatttggcaaagagggaactgaaatctggaaagtaaggacttgcccaaggtcactgacttagtggcagactagagacttgaactcaggtctccattcccagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 23351 - DNA, 2785 bp, Homo sapiens
  ENST00000376962
gggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 23352 - DNA, 2686 bp, Homo sapiens
  ENST00000376960
acagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaa

SEQ ID NO: 23353 - DNA, 1073 bp, Homo sapiens
  ENST00000343431
ccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggccctgaaaaggagcctttaaaagtcaattctactccatttggcaaagagggaactgaaatctggaaagtaaggacttgcccaaggtcactgacttagtggcagactagagacttgaactcaggtctccattcccagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttg

SEQ ID NO: 23354 - DNA, 553 bp, Homo sapiens
  ENST00000471197
gtcttgatactaagtgagtttttgtagtgttcattggttccttacaaatcctttttttaaataggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatat

SEQ ID NO: 23355 - DNA, 690 bp, Homo sapiens
  ENST00000376956
ggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacgcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaaga

SEQ ID NO: 23356 - DNA, 631 bp, Homo sapiens
  ENST00000487330
gcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggtaagttatttccaaggaaaaacacatttgaaagaactggtggacagaaatacagaaccaagaattggggctgagaatgctgaaagcacatggagagaacacctgataagagcttgaaattcaagcaacagcccaagtgcttgacatgactgatcaggaatgaatgactatctacaagcatcttatagct

SEQ ID NO: 23357 - DNA, 5310 bp, Homo sapiens
  ENST00000237937
aggccgcggatggcggcgtccgggggaggggagcccgcccgccagcccaggaagcacaaagacggaggcgtcatcctgtcgtcgtggcccgagacctggctcccggcgtccctggctcgctccacagcacgcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgacaattctgaagaagaaagtaggtatgacttagtttacaaaaagagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatggaagtaagagtggtatagagaaggtaagatgagccctcggactccatcactctgaaggtctgagtagtagcaagagatagatttttgtttggccaggctgcagtgcaatggcgtaatcttggctcactgcaacctctgcctcctgggttcaagtgattctcctgcctctgcctcctaagtagctgggatcacaggcaccagccaccacgcccagctaatttttgtatttttaatagagacagtttctccatgttggtcaggctggtcttgaactcctgacctcaggtgagctgcccgcctcggcctcccaaagtgctgggattacaggcgtgaggcaccgcacccggccaatcagttttttttgttttttttttgtttgtttgttttacaagaaacattaaaccagatcagaacaaagatttgtcagggttgtccattgactggggagaaagggaatcagtgtgtaaggcacctgagaggactcagttctacccaaattcttgcattcaaacctgaatgcaaggccatgaagtcctttgaaatgtacagatattaagcaatttaataatataccatgtttcccttacataagcagacaaatatttacacccccatgacctgaagttttgttaggctgtgaccacatgaattcgcagtataaatgggtgagtcctttttgaaaacctcatcttcagtgtgcctgatctgtaaaactagagcctcaggtttgatcctaggtaggcttcccacaacgtggggaaaattagtttgtgagggaaagctgtttctgagcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatttgttatttaaacttgcagtttaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagaggctccgtcgcccaggctggagtaaaatggcatggtctcagctcactgcaagttccgcctcccgggttcacgccattctcctggctcagcctccggagtagttgggactacaggcacccgtcaccacacctggctaatgttttttgttttttgggtttttttgtatttttagtagagagagggtttcaccgtgttagccagggtggtctcgatctcctgacctcatgatccgcccaccccggcctcccaaaatgctgggattacaggtgtgagccactgcgcctggccgactcttgtctgtttgaatgcaaagttctcaatagtggtttttgtccataagtattaacttataattttggagagtgataggtatggttgctggttgattagcaataagattatgtagccttaaactagctagaagagtttgcatgggtgaggcaacaggctgttaacaaaaagaaactggaaatacagtttcccctgtttgtttctcctgtttgtacaatctgctttaaaaacaagtgaacatgcaccatgtcagtcatggtgaatcggccaacagccagcccttgccagttgacatcacagtctaagatgggaaactggtacagatagacatgaagagagcttagcagtggttgaggtggtgactaaatatacagtcattgaataaataccgtgtagcaaatgtaaaaaaaaaaaaaaaagtacaacagaatacaaaagtgccatttaatattttatagctatttctatgcacaagtgctggttttaaatttatataaaagcaaagactgtttctgtgttttcttccagagtatttctgttacagccatagaagtaaagttaataaatgtaagactttttttgttt

SEQ ID NO: 23358 - DNA, 1814 bp, Homo sapiens
  ENST00000261749
aataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgta

SEQ ID NO: 23359 - DNA, 891 bp, Homo sapiens
  ENST00000561060
ggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgac

SEQ ID NO: 23360 - DNA, 1559 bp, Homo sapiens
  ENST00000559157
cgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccagatcaaaagacactgacttagctgcttaccagaaggggaacttgggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 23361 - DNA, 585 bp, Homo sapiens
  ENST00000561012
aataaacagcggacggaggggccggcggtggcggagccggagcaagcaggggttcggcggcattacctgtacccattcaccggcggctaccggcggcggcgcgcagcgtgtcaggcggagagacccgccgccaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtttcacatcctgggaatactgtattttcaatctgaggttggtggagtcgccggtagccacctaagataggaatgtcaatcagaagttttctagaatctatcttcagatgcaaacaatacagtggcctcttgttggagatccaaaggctcagaactcggaattactgtatgcaacaggaaacactaatctcaagcacctatgccaagttaggtgtgcaactgaggaacatggctcaagaaactaatcacagccaagtgcctatgctttgttccactggctgtggattt

SEQ ID NO: 23362 - DNA, 582 bp, Homo sapiens
  ENST00000564367
ggaggggccggcggtggcggagccggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggggtttgaatgccggtgtggaaatgtttactgtggtgtacaccgttactcagatgtacacaattgctcttacaattacaaag

SEQ ID NO: 23363 - DNA, 1472 bp, Homo sapiens
  ENST00000558494
ggagcaagcaggggttcggcggcattacctgtacccattcaccggcggctaccggcggcggcgcgcagcgtgtcaggcggagagacccgccgccaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 23364 - DNA, 558 bp, Homo sapiens
  ENST00000560470
taagttttagctacctaaaaaagtatgaaagaatattgtgtttgaaatctttttaacttggtttttaagtcacgtgctaactatcctacacagttgggacgctatgatttaccttcacatctcggaagttgtaaccagttgtgaggaagttaggaccttggggttacctaaagataatttatattaagttgttgggccataaaaactgggcagaattggccacgcgcggtgactcaacgcctgtaatcccagcactttgggaggccgacgcggactaatcacgaggtcaggagatcgagaccatcctggccaacatggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggatttt

SEQ ID NO: 23365 - DNA, 492 bp, Homo sapiens
  ENST00000560228
attcaggtttggttgctttggagtacagcttcaagtgaagttaatctgaggtgaagcaaacagaaaattgtggaggttttgttggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtttcacatcctgggaatactgtattttcaatctgaggttggtggagtcgccggtagccacctaagataggaatgtcaatcagaagttttctagaatctatcttcagatgcaaacaatacagtggcctcttggtgtgcaactgaggaacatggctcaagaaactaatcacagccaagtgcctatgctttgttccactggctgtggattttatggaaaccctcgtacaaatggcatgtgttcagta

SEQ ID NO: 23366 - DNA, 1446 bp, Homo sapiens
  ENST00000559835
gctttggagtacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgatt

SEQ ID NO: 23367 - DNA, 1602 bp, Homo sapiens
  ENST00000559775
ggagtacagcttcaagtgaagttaatctgaggtgaagcaaacagaaaattgtggaggttttgttggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttga

SEQ ID NO: 23368 - DNA, 780 bp, Homo sapiens
  ENST00000558688
tacagcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactggtaaggacctaaatcaaatgtttaaaattaaaatgatgttttataataatgcatagcttactgttgttgacttcaattaagattgttcctgttcccttgagagttaatattggatatacttcaccttctgaattttcttaaggaaataaaaatagctttgattatacacctaaaagtgaaatgaatagcttttttaaaaaaagttttatttcagttgaatttag

SEQ ID NO: 23369 - DNA, 568 bp, Homo sapiens
  ENST00000560392
acagcttcaagtgaagttaatctgaggtgaagcaaacagaaaattgtggaggttttgttggtggagataagtaattaacatttcgaaacaggaaatgaaaggatttatatttttaaaagctataggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccag

SEQ ID NO: 23370 - DNA, 560 bp, Homo sapiens
  ENST00000560976
acagcttcaagtgaagttaatctgaggtgaagcaaacagaaaattgtggaggttttgttggtggagataagtaattaacatttcgaaacaggaaatgaaaggatttatatttttaaaagctataggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttg

SEQ ID NO: 23371 - DNA, 583 bp, Homo sapiens
  ENST00000558272
agcttcaagtgaagttaatctgaggtgaagcaaacagaaaattgtggaggttttgttgatactttggtgttgaacatttgggatagaagagagaaatttaaaattaaaaattttccatatttctatcacaaatattggtaatttgacaacatgtaatttgattgtcgtcttaataaaatttaatgttattgctaccaaatagagataaaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttc

SEQ ID NO: 23372 - DNA, 566 bp, Homo sapiens
  ENST00000558390
agcttcaagtgaagttaatctgaggtgaagcaaacagaaaattgtggaggttttgttggtggagataagtaattaacatttcgaaacaggaaatgaaaggatttatatttttaaaagctataggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccg

SEQ ID NO: 23373 - DNA, 532 bp, Homo sapiens
  ENST00000557793
gcttcaagtgaagttaatctgaggtgaagcaaacagaaaattgtggaggttttgttggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctggtaagtaattctagtgaaacccgtctatattcataattgaaatacaagtggatatttcggtatacccaatacctttttctgctctcacattatatttatattaccatattcatatcagtaaaatttctcattacacattgtgattataatcagtagtgaggagttaggaatgagtatcatcactcattgaaaatactgtaaattcataccataatcttatttctgtggctgtggaattctgttactttatttagaggggacacctcaagtgtcttggaaagtaagggaagagagtgataaaaga

SEQ ID NO: 23374 - DNA, 741 bp, Homo sapiens
  ENST00000558997
cagatactttggtgttgaacatttgggatagaagagagaaatttaaaattaaaaattttccatatttctatcacaaatattggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgg

SEQ ID NO: 23375 - DNA, 909 bp, Homo sapiens
  ENST00000558087
cagatactttggtgttgaacatttgggatagaagagagaaatttaaaattaaaaattttccatatttctatcacaaatattggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtgg

SEQ ID NO: 23376 - DNA, 621 bp, Homo sapiens
  ENST00000558724
gaagagagaaatttaaaattaaaaattttccatatttctatcacaaatattggtaatttgacaacatgtaatttgattgtcgtcttaataaaatttaatgttattgctaccaaatagagataaaggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgg

SEQ ID NO: 23377 - DNA, 470 bp, Homo sapiens
  ENST00000561017
tgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcagggtttgtatatgaactagcatgtattttgttatttgagtattataggccagacactatcctaggtgcatgtataaaaaaattgccagcttaaaatacatgtttttctgttttccctatgaacacaatactttatatctttaagtatttaattaacatgttggggagccatttcacacttacatgtaattttatcatcagcataaatgttgcaaattcaaaatttgtttagtttggaaaatataattaaatgaatgtgtggcagtgtta

SEQ ID NO: 23378 - DNA, 2594 bp, Homo sapiens
  ENST00000557983
ttgtcgaatgtctgctatgtggttggagacactgggataggcactgataatgggataaataggaccgatgtctcccctcaaagaattcaaagttaaaccaagttaagccaatgagggaattttaatatgaaaagtgctatacacagggtttcccaccccaaggttgttggagaggcagtggaggaagagctgattatataagcttaaacaagaaaaacaagttagagttagcctgataaaaagagggacaggaggggcatagaaagagtattttgtatggaaagcacaacttatacaagagcccagaggcaaaagagagtttgatatgtccagggaaactgcaagtccttcagtatggctgaatcatggagtactgttgaggaatagtgagagatgaggctagagaaagaaggatgaagaaaatcatgaaggacctctgggctttatcctggggggtagttgggagccattgaggaattctaaacatcagagggaacaccattagattttcacttaaggcagatgattggatgcaatgtgtgaagcatggattgtagagggaactcatgaggtgcccagtatttggaaaaggtgttaaggaaaatcagagtgagaagctacagagaattgagacaaggaaagggtatttgaccttggtcttgaaaaagaggaggacctagatcaaatggggaaaaaggaaaccctttggaatagattctaagaagtgtgagcaaaggtacatggcatattcccagtgtagattaatggagcagtggatccctggggaaagtctagttggggataaaactggagaggttaagaatttgatccatgggaaattccaccattttagagcaaaatgtcacgtctgcaaggtcatattatatgattctgactctggcgacagcattcatgagggctagagtagttagcaactggagggaggcatgttaagatttcagagtagtaatttaacccgaatcttggtaaatctggctttggtttccatacataaatgcatcaacttattatcttacaacattttaaagcttctttgcttcaatttgccttatttctaacatttaaagtgcttttatgtgaaacattctgggaactttaaacatacttaatattccacagaatcttggtttcaccttttccctcctcgttctctgagagacctatgtcattctgaccccgaacaatattaagaactatgcatatggctattgtcttgcacactcccttagaatattcaagtagtatttgtttatgtgccttttattgattaaatttgtagttactagaaaaattagaaagtacagttaaaacctaaagaaagtctataaaaccactgttaacatatcattacatattctagattattttctacatgcatatatacatacatttaacaaaaaggggtcatatttttgtaaacaactttgtaatttaatgactagttttctgtgctaataaattcctcagtatcctctgaataatagactagggagggtgggatgaggaatagcaaaatcttacagaataattaaattttgccaccttcgtatttttgttagcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccag

SEQ ID NO: 23379 - DNA, 1659 bp, Homo sapiens
  ENST00000618205
agcgggttgcgagcggttggctggcgggggtcggaagggccccgggcacactggggcgcgtcagttccccgcctcctccgagtctcaggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgt

SEQ ID NO: 23380 - DNA, 1653 bp, Homo sapiens
  ENST00000616533
cagatactttggtgttgaacatttgggatagaagagagaaatttaaaattaaaaattttccatatttctatcacaaatattggaatgaatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgt

SEQ ID NO: 23381 - DNA, 1729 bp, Homo sapiens
  ENST00000613266
aataattagcgggcgggcggggcccgcgcgtcagccgcgggagccggccaatccagtggctctcctccgcggtcgcgtcataggccgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccagatactttggtgttgaacatttgggatagaagagagaaatttaaaattaaaaattttccatatttctatcacaaatattggtgtgcaactgaggaacatggctcaagaaactaatcacagccaagtgcctatgctttgttccactggctgtggattttatggaaaccctcgtacaaatggcatgtgttcagtatgctataaagaacatcttcaaagacagaatagtagtaatggtagaataagcccacctgcaacctctgtcagtagtctgtctgaatctttaccagttcaatgcacagatggcagtgtgccagaagcccagtcagcattagactctacatcttcatctatgcagcccagccctgtatcaaatcagtcacttttatcagaatctgtagcatcttctcaattggacagtacatctgtggacaaagcagtacctgaaacagaagatgtgcaggcttcagtatcagacacagcacagcagccatctgaagagcaaagcaagtctcttgaaaaaccgaaacaaaaaaagaatcgctgtttcatgtgcaggaagaaagtgggacttactgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttgaactcctgctggaatacaaaattcttgagcatctgcaaactaaaaattgacttgaggttttttttttcctagtcattgggaatgtagagcagtgtatcttgcatgtcatcggaagaatagatttttgttttggttttgttttgaaaatgactctgaacatttatttccattgcaatttctgtggctgaggagacttaaactttacaagtattatccttttaagatcattttaattttagttgagtgcagagggcttttataacaaacgtgcagaaattttggagggctgtgatttttccagtattaaacatgcatgcattaatcttgcagtttattttctcattgtgtatgtatatatcgcttttctctgcagcacgatttctcttttgataatgccctttagggcacaactagttatcagtaactgaatgtatcttaatcattatggctgcttctgttttttcattaacaaaggttattcatatgttagcatatagtttctttgcacccactatttatgtctgaatcatttgtcacaagagagtgtgtgctgatgagattgtaagtttgtgtgtttaaacttttttttgagcgagggaagaaaaagctgtatgcatttcattgctgtctacaggtttctttcagattatgttcatgggtttgtgtgtatacaatatgaagaatgatctgaagtaattgtgctgtatttatgtttattcaccagtctttgattaaataaaaaggaaaaccagaatgctcccttgt

SEQ ID NO: 23382 - DNA, 14019 bp, Homo sapiens
  ENST00000521891
attcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcgtaaataatgagctgccgcctgaaatccggcttgccagtggtcagctaatgggtgatgacctgtccctccttactgcaggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaacatttgctgctactgtgttaacatttttgttttgcttgccatgaatttcaacttccaccacccagtgaattgatttataaattgctatgctttgctgtttttctgttgctgtggaacttaaagaatgtgaaagctgtcaaagggtattttacgaatcacttttgtgtttgatatagtaaaacaatgtgattcattccaaagtaacagaaggttatttgtaagaaagttaaaggcttgtgaacaaagaaagctaagctgttgtacatatttgtagttggctgtgcatggtacaaatttattaatatgaagaaatgcaaaatgtattgcttttgatatttctcttccgagatgaacaagtagcatgtaatgcaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagccaaaaaaagaaaaaaaaaagaaaaaaaactttaactggatggacgttgttagggtgagaaataaaaggacagcctccaaaggttgagaatgagaattgttttttcctggatatcaaagggattatcacagcgcaatcattgtctacacaacatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatattta

SEQ ID NO: 23383 - DNA, 614 bp, Homo sapiens
  ENST00000517683
gaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaacacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttg

SEQ ID NO: 23384 - DNA, 3612 bp, Homo sapiens
  ENST00000458716
atttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaaggtaagcagtgacatccatttccgttggcacagagtagaaaagggaattaactctttcagagcttggagcacaagtctccaacttaaggaaaaaaaaagagaaaaaacatcaaagggcagggggcacagtttctgattaacattataaaaacatattgaaatatatggaattgaaggctttatttataaagttttaccctatgtctcactt

SEQ ID NO: 23385 - DNA, 618 bp, Homo sapiens
  ENST00000520307
atcgcccggcctctgggccagggacccgcgaggcggcggctgcttgctccgaacggaacgccgccgggtgtgcgttagaccagcggatagacgcccgcggcttggggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactgggg

SEQ ID NO: 23386 - DNA, 524 bp, Homo sapiens
  ENST00000523885
gtagtattatatttttagttgggtggatggatggaagagtgagagagaggctgcggctgccgctgccttttcgggtgttgcttagattaaggctgagacttggctgcgattgggacgcgacagtgacacgggcatcgatcgcttccattgagagcaatgcaaaaacacagcccgggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccct

SEQ ID NO: 23387 - DNA, 613 bp, Homo sapiens
  ENST00000517585
atagcacaatccccttgtttaaccaatacggaaaccaaagctcatggaaattcctgggaaacatcacataactacagagtgcagctgaagaaattgagtgtgtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactgggg

SEQ ID NO: 23388 - DNA, 561 bp, Homo sapiens
  ENST00000523809
acggaaaccaaagctcatggaaattcctgggaaacatcacataactacagagtgcagctgaagaaattgagtgttcactgcctgataaagaaaaggtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatat

SEQ ID NO: 23389 - DNA, 12175 bp, Homo sapiens
  ENST00000518282
ccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaaca

SEQ ID NO: 23390 - DNA, 989 bp, Homo sapiens
  ENST00000523625
caaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagcttatttatccacctactgagaacatcttggttgattccaagttttggcaattacgaataaaactactatgagcatcggtgtccaggcttttgtgtggacataaattttcaactccctttgataaatgccaaggagtacaattactagattgtatgataagagcatgtttagttttgtaaaaaccaccaaactgtcttccaaagtggttgtaccattttgcattcccaccagcgatgaatgagagttcctgttgccccacatcatcaccagcatttgatgttgtcagtgttctggattttggccattttcatagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttat

SEQ ID NO: 23391 - DNA, 441 bp, Homo sapiens
  ENST00000524290
caagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcaggtaatggttcctactccttctcaaaatatttccttgtcctaaatgagttgcttttgttactctcataattgatggaataaacattctctggaacttctctaattagatctgatcatatgccttattcaaataagtaaaaagcaaaatgaaataaattcaataattggaagtatatgtaaattgactttacattttagagcagttttaggttcacagcaaa

SEQ ID NO: 23392 - DNA, 491 bp, Homo sapiens
  ENST00000519536
caagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgcatcttcttgccaaatcttctggagcgcttgtaatttcctctgtacagagcccaacaggctcatcagcagcagaagaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagag

SEQ ID NO: 23393 - DNA, 623 bp, Homo sapiens
  ENST00000522409
gtatttcttcagagctaattaaagctctgttattgctcgtgttatagtagtcacactcaaggcccatttgtgacctcttttgcttggaaaaaaatatggtacaaggcatagcttagtaaagaacattattttgcagtcttctttttatatctataatgttcatcaaataaccccagtgggcaccttgcatttcaaacttgcttcattatcattataaaaaaataaacctacaggaacctttaagccataataataataatacaacattgccacagcattgatctaaagtggcaaggtgtggcattgatctgtaacatctgcaaaacatccctgctttggctaaaataaacaaatgtaagtgggatatgctaccagcaaaagagagatgtgatggaatttgtgatttctggggtacatttaacataaacccctttggtttccaaaggtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtgg

SEQ ID NO: 23394 - DNA, 3094 bp, Homo sapiens
  ENST00000555997
aattgcaaaggcatcttctcagtgaagggggcggggtgggctagggctgagtggaaatggtgagagagattattgtagaaaatatctcttccgggaacttagggcaaagagttttattttcaggaatcacatccctgtctcccccaacctcagaccaggcccccaatctcctccccacaagaaaaagcaaaggcagtctgaaaacctgttgccaaaggaagggaacacttctgaaggaggaagttgagagtcttaggccagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaaca

SEQ ID NO: 23395 - DNA, 3190 bp, Homo sapiens
  ENST00000439696
gtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaa

SEQ ID NO: 23396 - DNA, 3026 bp, Homo sapiens
  ENST00000336440
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggactcgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcggcgcactaaattgtgccgcgctcgcccccgccagaccatgtcctcctggggaaaaagtttccctagtccccccagcagcgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagct

SEQ ID NO: 23397 - DNA, 727 bp, Homo sapiens
  ENST00000557086
tttcactttcccccttgcacaaaaccgaacatcccaccccaccaccacctccaagctaaaatacctgggccgcccctccccacgaagggacgcgctccaggcgaatggggagggcccggaagtcgggcctgggacagaggagccggcccaccgcctcccggtcggaagcggcagtgcagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctt

SEQ ID NO: 23398 - DNA, 577 bp, Homo sapiens
  ENST00000557022
agtgcaggtgaggcggcggccagcctggggactgcgcggggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctcc

SEQ ID NO: 23399 - DNA, 633 bp, Homo sapiens
  ENST00000553375
caccaccacctccaagctaaaatacctgggccgcccctccccacgaagggacgcgctccaggcgaatggggagggcccggaagtcgggcctgggacagaggagccggcccaccgcctcccggtcggaagcggcagtgcagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgcc

SEQ ID NO: 23400 - DNA, 2072 bp, Homo sapiens
  ENST00000496039
gggcggccggcaggggcccagccctgccttccactgtgctctctgtcagctccaggtcaattcagagacccaactgaagcaggtgggagaagtgaggctgtgactggggttggagccaggggagggggttggggggcagggcagcagagggagggaccctgaagagagcaggcagggcacagcagagcaggctggagaagcgaggccagcaggccagtgggccaattaagggcaaaggccaagactcacctccccttcccagggcctaccccagggtgaggacccagtctgtgtgctttggatgtatgagctgtggatagaggaaggggaagagtcgaggatgatggtcttggggtccttgggctttgtcatcttgttcccagtctgtctgtctgtccattagcacatgagcagcaggaggcacaaagaccgcctggccgggaagacccccaagccctccagccagcacagcaagctgcagaagcacgcagcgctggctgtgagtatcctcaagtctaaactggccttgcagaagcaactcaccaagacgttggcagcccgcttcctgcccagcccgctccccaccgcagccactgccatctgtgctctgccagggcccctggccctccgccctgcccctacagcagccactaccctcttcccggctcccatcctgggcccagctctgtttcgcaccccagcaggagctgtccgccctgccacaggacctatcgtccttgccccttattagccctcatggggaggccagagctgatttcccaatagccactccttgtctcctcctgtcctgagacaccttggtttcctacatgccacagggactgtgaacagcttcaggggtcctgcccgatccagaaagagctgggctagttttaagggcagctgccttccaaggactgtccccaccctcctttcgcaggccttccagggttaatcctaggcttgcctgcatttcccaccctgacagaccccaaagatctatgcaaaatctcagccccagccatgtggtgctctcactttcctccacccaagacccacatggccagactctaggaatcttagcttctacaagccatcctctcctagccaggggacgactctctgacctctattcctaggctttggggcttcactggagatagggatggggtctctagctgcagcaggctcaaggctgtcaggacaaggtgaccatgggagtgtgacagaggaccatggaggagaaagggggacccaaaagtccttcgatcagcagtgctaaggtggggcagagccaaggaggtagtggggctggttctgaaagcttttgggggcttcatctgctctgaaggggtgggactaagagaggaggtgatgttctggttgggcccagggttttgttttaatcttaagtcttctgggcattcatgggcccagtctttttttctgtctgagagtatcattctgttgcccaggttagagtgcagtggtgcaatcttggctcactgcatgcagcctctgcctccctggttcaagtgatacttgctgataagcccagtcttaatattgagggagtaactcatccctcagaagctcttcttcttagcctttctctgacttcctgaaccccaactcttggagggcgggtgtgggtctccctcagactatggactcagctaacaccgaaccccccgcagagctcccaaaggaagagctttcccctacagcttcccactccaaactggtcctagcactaaattcagctttcccttctcccaaccagcccctgccactgtgaagctgagtgttgggaggcagtctcacatgcactggcaagacccattttcatgctgtcaatgtcaatgtcacaaactcctttccactgcagcactgccccctccccaccccacaatatgggaccctgccagtatccccctgtatcttttttttgttttttaaagacatttccaatgggagaaccagaaaaagggggaggggagggaaactttttgataacaattgtggttttattgtgtccaaccaatgcatcaataaatgaacttgaagcccaa

SEQ ID NO: 23401 - DNA, 1989 bp, Homo sapiens
  ENST00000461831
ctcaagggttggatggcggaggctttgtgcttgtgtgttactgaacggacgtttctgggtcctcccattactccttggggaaggagaattgggaagagaagtctgaggcagcaagaactgaaggagccaagcaccggtggatgatggaaggtcagcgaggggctccccggaggagccggggccgcccggtgtccaggggaggtgccggacacaaagccaagagagtcacagggggccggggcggccggcaggggcccagccctgccttccactgtgctctctgtcagctccaggtcaattcagagacccaactgaagcagcacatgagcagcaggaggcacaaagaccgcctggccgggaagacccccaagccctccagccagcacagcaagctgcagaagcacgcagcgctggctgtgagtatcctcaagtctaaactggccttgcagaagcaactcaccaagacgttggcagcccgcttcctgcccagcccgctccccaccgcagccactgccatctgtgctctgccagggcccctggccctccgccctgcccctacagcagccactaccctcttcccggctcccatcctgggcccagctctgtttcgcaccccagcaggagctgtccgccctgccacaggacctatcgtccttgccccttattagccctcatggggaggccagagctgatttcccaatagccactccttgtctcctcctgtcctgagacaccttggtttcctacatgccacagggactgtgaacagcttcaggggtcctgcccgatccagaaagagctgggctagttttaagggcagctgccttccaaggactgtccccaccctcctttcgcaggccttccagggttaatcctaggcttgcctgcatttcccaccctgacagaccccaaagatctatgcaaaatctcagccccagccatgtggtgctctcactttcctccacccaagacccacatggccagactctaggaatcttagcttctacaagccatcctctcctagccaggggacgactctctgacctctattcctaggctttggggcttcactggagatagggatggggtctctagctgcagcaggctcaaggctgtcaggacaaggtgaccatgggagtgtgacagaggaccatggaggagaaagggggacccaaaagtccttcgatcagcagtgctaaggtggggcagagccaaggaggtagtggggctggttctgaaagcttttgggggcttcatctgctctgaaggggtgggactaagagaggaggtgatgttctggttgggcccagggttttgttttaatcttaagtcttctgggcattcatgggcccagtctttttttctgtctgagagtatcattctgttgcccaggttagagtgcagtggtgcaatcttggctcactgcatgcagcctctgcctccctggttcaagtgatacttgctgataagcccagtcttaatattgagggagtaactcatccctcagaagctcttcttcttagcctttctctgacttcctgaaccccaactcttggagggcgggtgtgggtctccctcagactatggactcagctaacaccgaaccccccgcagagctcccaaaggaagagctttcccctacagcttcccactccaaactggtcctagcactaaattcagctttcccttctcccaaccagcccctgccactgtgaagctgagtgttgggaggcagtctcacatgcactggcaagacccattttcatgctgtcaatgtcaatgtcacaaactcctttccactgcagcactgccccctccccaccccacaatatgggaccctgccagtatccccctgtatcttttttttgttttttaaagacatttccaatgggagaaccagaaaaagggggaggggagggaaactttttgataacaattgtggttttattgtgtccaaccaatgcatcaataaatgaacttgaagcccaa

SEQ ID NO: 23402 - DNA, 1572 bp, Homo sapiens
  ENST00000436535
agccccacacgcagcgttcccagccaggcgagagcaggtggccgcggcgggctccgtctctgccccgcagatatgaagcggccactgagcccacccccaccggctgagaaggagacccccatatctggagctgctgagtgcctccctcggcccccagaaccacctaagcccaagcgagaaagaaagcggccatcgtacacgctctgtgatgtctgcaacatccagctgaactcggcggcccaggcccaggtgcactgtggggggcgggcccaccagaggcggcttcggcagctcagcttggggaagagcccctcagggccagcaggcccggcctccggcgcccccagccccctgctggcctccctgcccctgcccacccggcctctgcagcccccgctggacttcaagcacttgctcgccttccacttcaatggcgctgccccgctcagtctcttccccaacttcagcacgatggacccggtccagaaagctgtcatcagccacacgtttggtgtcccctcccctctgaagaagaagctgttcatttcctgtaacatctgtcacctgaggttcaactcagcgaaccaggccgaggcacattataaaggccacaaacacgccagaaaactcaaggctgtcgaggctgccaagagcaagcagaggccacacacccaggcccaggatggggctgtagtgtccccaatcccaacgctggccagtggagcccctggagagccacagagtaaagcagttcctgcagcccctcctcttgggcctccactccagccaccaccaactccagaccctacatgcagggagccagcccactcagagctcttggatgctgcctcctcatcctcttcttcctcctgcccaccttgctccccagagcctgggagagaggcaccggggcctgagccagcggcagctgccgtgggaagcagcatgagtggggaaggcaggagtgagaaggggcacctctactgccccacgtgtaaggtgacagtgaactcggcctcccagcttcaggctcacaacacaggagccaagcaccggtggatgatggaaggtcagcgaggggctccccggaggagccggggccgcccggtgtccaggggaggtgccggacacaaagccaagagagtcacagggggccggggcggccggcaggggcccagccctgccttccactgtgctctctgtcagctccaggtcaattcagagacccaactgaagcagcacatgagcagcaggaggcacaaagaccgcctggccgggaagacccccaagccctccagccagcacagcaagctgcagaagcacgcagcgctggcttctaaactggccttgcagaagcaactcaccaagacgttggcagcccgcttcctgcccagcccgctccccaccgcagccactgccatctgtgctctgccagggcccctggccctccgccctgcccctacagcagccactaccctcttcccggctcccatcctgggcccagctctgtttcgcaccccagcaggagctgtccgccctgccacaggacctatcgtccttgccccttattag

SEQ ID NO: 23403 - DNA, 2085 bp, Homo sapiens
  ENST00000453355
gtctgctcaggttgccataacaaagtaccacagactcagtggcttcgacagtggagatgtaatttctcacagttctggaggctagaagtccaagatcaaggtgtcaggagggttcatttcttcaaaggcctctcttcttggcttgaagatggtcttccctctataactatctgtgtctaaatttcctcttcttataaagacaccagtcatatgagacccagcgcggtggctcacacctgaaatcccagcgctttgggaggctgagatatgaagcggccactgagcccacccccaccggctgagaaggagacccccatatctggagctgctgagtgcctccctcggcccccagaaccacctaagcccaagcgagaaagaaagcggccatcgtacacgctctgtgatgtctgcaacatccagctgaactcggcggcccaggcccaggtgcactgtggggggcgggcccaccagaggcggcttcggcagctcagcttggggaagagcccctcagggccaggtcagtgtagaggggacgctgctcccacaaatttggtttggggagtatctctgtctgggcccctctgaggggctctgggtctgtggcctccctccatgggggtctttgcgtctggggtgccctcaatggggtcttagggtctgaagcctccccgatgccagcaagttttattctgcatctggacaacccttctgtaggacctctcggaatctgtgggtccttaggccgcctcttgggtctttgtttctagggaactctccctgtgggatcttttgggatcaggactcctaagcagcacttctccagcctggagcctcctggtagccacaggctttcagacaagggcctcatctgcggggtgggggtcccaggctccagctcaggtctgtggtctctgaaggccaaggtcagcaaggtacacagcactccaacccagggacaagggggaggcccctcttcctttggactcctggccaggatttctgcttctccctagctggggtgactttgcagaggtttggctatgagcttggaaggggcagctggctgcaaggcagatttctgggggaaatgggtgaatgcctccatgagggtgattctagctgacaggtgcacaggggccatagggaaagtaagaaccacccaggctgctgttggcagagcaaacagattcacattcaggctcagtgtggggaggtgggaaaggcaggaacttacccctggctcctgggggaggccaacagaaacctaccttgcagcccaggctggcagttttgccggaggctacactctgacctcagacaccctcttgagggctgtcttctcttttggtgatattcatggggcacccactgtgtcccccgctccacacacacaatcctgtaggccagagacaagtaagatccaatctctctgcttaccaccctccccaagattgagtgggtcttttgggtggagacacatgtgaaaagggataagggttgtggttgccacatgggacataccctcagggcacaaaggcaaagctgcagtccctgggggcagcaggaaagtctcctgaaggaagagggggctgagcctcggaacatggatgaggggagtaggggcattacaggcagaggtcacggcataagcaaaggccagggtgctctggtgactgggaccagctcctccccacccaattatttcaggctggacaccaaaagcatgactctgagcaagagagtatctgactgatgggtgtttctggagcatatgtgtctgtctggattcgaaagtcactcattggctgggcatggtggctcatgcctgtaatcctagcactttgggaggctgaggcaggtgggtcacttaaggccaggagtttgagaccagcctggccaacatggcaaaaccccatttctactaaaaatgcaaaaattagccaggtatggtggcacacacctgtagtcccagctactcgggaggctgaggcagacgaatcacttgaacccaggaggtggaggttgcagtgagccgagattgtgccactgcactccagcctgggtgacagagtgagaccctgtctc

SEQ ID NO: 23404 - DNA, 2596 bp, Homo sapiens
  ENST00000618554
atgggtctggctgcaggcccggcctccggcgcccccagccccctgctggcctccctgcccctgcccacccggcctctgcagcccccgctggacttcaagcacttgctcgccttccacttcaatggcgctgccccgctcagtctcttccccaacttcagcacgatggacccggtccagaaagctgtcatcagccacacgtttggtgtcccctcccctctgaagaagaagctgttcatttcctgtaacatctgtcacctgaggttcaactcagcgaaccaggccgaggcacattataaaggccacaaacacgccagaaaactcaaggctgtcgaggctgccaagagcaagcagaggccacacacccaggcccaggatggggctgtagtgtccccaatcccaacgctggccagtggagcccctggagagccacagagtaaagttcctgcagcccctcctcttgggcctccactccagccaccaccaactccagaccctacatgcagggagccagcccactcagagctcttggatgctgcctcctcatcctcttcttcctcctgcccaccttgctccccagagcctgggagagaggcaccggggcctgagccagcggcagctgccgtgggaagcagcatgagtggggaaggcaggagtgagaaggggcacctctactgccccacgtgtaaggtgacagtgaactcggcctcccagcttcaggctcacaacacaggagccaagcaccggtggatgatggaaggtcagcgaggggctccccggaggagccggggccgcccggtgtccaggggaggtgccggacacaaagccaagagagtcacagggggccggggcggccggcaggggcccagccctgccttccactgtgctctctgtcagctccaggtcaattcagagacccaactgaagcagcacatgagcagcaggaggcacaaagaccgcctggccgggaagacccccaagccctccagccagcacagcaagctgcagaagcacgcagcgctggctgtgagtatcctcaagtctaaactggccttgcagaagcaactcaccaagacgttggcagcccgcttcctgcccagcccgctccccaccgcagccactgccatctgtgctctgccagggcccctggccctccgccctgcccctacagcagccactaccctcttcccggctcccatcctgggcccagctctgtttcgcaccccagcaggagctgtccgccctgccacaggacctatcgtccttgccccttattagccctcatggggaggccagagctgatttcccaatagccactccttgtctcctcctgtcctgagacaccttggtttcctacatgccacagggactgtgaacagcttcaggggtcctgcccgatccagaaagagctgggctagttttaagggcagctgccttccaaggactgtccccaccctcctttcgcaggccttccagggttaatcctaggcttgcctgcatttcccaccctgacagaccccaaagatctatgcaaaatctcagccccagccatgtggtgctctcactttcctccacccaagacccacatggccagactctaggaatcttagcttctacaagccatcctctcctagccaggggacgactctctgacctctattcctaggctttggggcttcactggagatagggatggggtctctagctgcagcaggctcaaggctgtcaggacaaggtgaccatgggagtgtgacagaggaccatggaggagaaagggggacccaaaagtccttcgatcagcagtgctaaggtggggcagagccaaggaggtagtggggctggttctgaaagcttttgggggcttcatctgctctgaaggggtgggactaagagaggaggtgatgttctggttgggcccagggttttgttttaatcttaagtcttctgggcattcatgggcccagtctttttttctgtctgagagtatcattctgttgcccaggttagagtgcagtggtgcaatcttggctcactgcatgcagcctctgcctccctggttcaagtgatacttgctgataagcccagtcttaatattgagggagtaactcatccctcagaagctcttcttcttagcctttctctgacttcctgaaccccaactcttggagggcgggtgtgggtctccctcagactatggactcagctaacaccgaaccccccgcagagctcccaaaggaagagctttcccctacagcttcccactccaaactggtcctagcactaaattcagctttcccttctcccaaccagcccctgccactgtgaagctgagtgttgggaggcagtctcacatgcactggcaagacccattttcatgctgtcaatgtcaatgtcacaaactcctttccactgcagcactgccccctccccaccccacaatatgggaccctgccagtatccccctgtatcttttttttgttttttaaagacatttccaatgggagaaccagaaaaagggggaggggagggaaactttttgataacaattgtggttttattgtgtccaaccaatgcatcaataaatgaacttgaagcccaa

SEQ ID NO: 23405 - DNA, 4808 bp, Homo sapiens
  ENST00000344423
aggttcaagtgcgcatgtgcgcgaggagtcgctcgggcacttattgagcgccgactgtctacgggcggccgggggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctgatttaa

SEQ ID NO: 23406 - DNA, 625 bp, Homo sapiens
  ENST00000520535
ctgccctcaggggctctcagcaagtcagctcctgggtccttctggcacattcaggcagatcatgcataccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaa

SEQ ID NO: 23407 - DNA, 2068 bp, Homo sapiens
  ENST00000523202
ctgcacagggagtttgtcttgtgcaaacaatttccaaggcagcgttttcttccctgcctgggagtgcagggctcagcgccttcactttggaactgactcagagacctaaagaagcccacctggccagcgggaaggggggccgccgccgcctcccggttttgggcagccctggccagctccctgtggccttggaggacttccaccgggcaggcgttcccatgatgccaggctaccaggcgcgggggattcctgcaggccggcgctgcttttcttagaaccccctttctagaaaagtacacctgggggttttgcttcaaagagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaa

SEQ ID NO: 23408 - DNA, 1790 bp, Homo sapiens
  ENST00000523095
gctagccgtccgagccgagccgtccgagccggggaagccgggcgcgtgctgccgctcgtggcgggccgaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctccca

SEQ ID NO: 23409 - DNA, 573 bp, Homo sapiens
  ENST00000517372
tggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggtatggggcggggctcgctggaggctcaggctcatagctgactcatcacgggccagcttgattacaggctaccgacc

SEQ ID NO: 23410 - DNA, 699 bp, Homo sapiens
  ENST00000521912
gtcttgcactgtttcctaggctggagtgcagtggcacaatcacagctcactgcagccttgacttccccaggctcaagccattctcctacctcagcctcccaagcagttgggaccacaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgg

SEQ ID NO: 23411 - DNA, 703 bp, Homo sapiens
  ENST00000520290
gcgaggagtcgctcgggcacttattgagcgccgactgtctacgggcggccggggacagtcttgcactgtttcctaggctggagtgcagtggcacaatcacagctcactgcagccttgacttccccaggctcaagccattctcctacctcagcctcccaagcagttgggaccacaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaa

SEQ ID NO: 23412 - DNA, 584 bp, Homo sapiens
  ENST00000521185
acttattgagcgccgactgtctacgggcggccgggggcctgagccgcgccttgctgctgggtctccacttgtggggaagagagaactggaccaggacagcgcgggaaactgacaatgccactgcttgctagctttgggattttggacaaataggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctgg

SEQ ID NO: 23413 - DNA, 501 bp, Homo sapiens
  ENST00000522795
ggagccgggccgcgggccgcgccgggagggcgggcagggccgcggccgctgcagcccggagctgagctagccgtccgagccgagccgtccgagccggggaagccgggcgcgtgctgccgctcgtggcgggccgaggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtca

SEQ ID NO: 23414 - DNA, 224 bp, Homo sapiens
  ENST00000517459
tcgggttctgtggacacaggcaggaagcttaagaggctctgctgagcagggacctggggaagaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcacca

SEQ ID NO: 23415 - DNA, 413 bp, Homo sapiens
  ENST00000519730
tcttgcactgtttcctaggctggagtgcagtggcacaatcacagctcactgcagccttgacttccccaggctcaagccattctcctacctcagcctcccaagcagttgggaccacaggcctgagccgcgccttgctgctgggtctccacttgtggggaagagagaactggaccaggacagcgcgggaaactgacaatgccactgcttgctagctttgggattttggacaaataggtgtttcttgatttctcttggctgctccagaaccatatggcaaactaggggatggctggtttatagggaccattgatagctcccaagaaagaacttaccagaggagtgaatgaagtggagattctggaggagagaggttggaaggaggccaccgctggaatggtggaagtgcaccaggt

SEQ ID NO: 23416 - DNA, 7907 bp, Homo sapiens
  ENST00000561648
gaagaaaatcaaaccctccggaatgtccccctgaagaggaccactgttgcagcggggaccctcctttcaggcatcctcattttatcatgtccctttgctttcttccccagtggccttttcaaaggtcagagagaaatgcttagtcaaacccctacttgagtatcacaggtgactaattttgggatcgaagattaaggaggttttgttgcgtccttaaagaacttggaattggagtccaggtagttttggaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagcatccggctgcctggttctctcctccccagcctagggccgcgtggggggctgtcagctcctgtaaggtgtgttcccctacaagttcctgtgggcttgcacacgcccttggggacctgcacacaatagaccctgctccccttggaaaagaatcgtagtaacctaatgcatgcagactggacaggctggcagtggccacaggagtcaaagcagaagaccccttaatgatggaataccctgatcttcccactcttggatggggaaacagaggcccaagggtaacgtgcagctttcccaaggccacgcagcaggttggtcaccatgctgattgtgaagtcttcttggctttcccttcagggttggctttcccctttgttggatacaggcaggcaagtgggtagcccttcccttgccaggactccaggtggcacttgggttctgaggcacggagatgtgtgactggggactgcagagcagagccaggtaggagccgcaggttcccagtcatagagatcagtaggatgtgagagcattgagactggtggcgggggccaggtctggagtgaggcaggcaggggcctggggtacattatttcagggggcactcgctctcagggcccccctacacctgcaagtgctgggaatgggtgtcctcttgcattttacactctaggcaccttgcttatttcacctactcctggccctgctggcctcccagggcccacccagcagccttggtctccaggcctcctccatgttacctcccacacctccatcatgctggtgctcagctgacttgccaatcagaggccagaacttgcacggggaaacccttccttgctaacttttcacaaggggcaaggaaattggttattaccctctgcagagcggaaatgaaacaggcagacagattgcacctaattataatgtaatactaagtcacgggtgtggaatttggagcaattatacccatcatcttctagaagactcccatatcaaggggcttctggtgacctataagagttcccctttctttctgtcacctcatgtaatgttctcacgcgggtggggctttcagtttttcaaaaggcatcttacatatgtgaatcatagagcagaccctgccagtagtgggctgttgcctcctggaaactgaaggctgtgaatgccaattttcagcctcctggagacctggcagttttgggggaagaccccagggtagacaccagtgttcctctaagtgtgcccacccgtggactggggcttggggcctggggctggggctatgtctgagtgaggctgccacacatccacagccaggcctaccttttgggcagtgctgggactgtcgatgggaccagtatgtcccggggcctgccacatctccgtctcagggccctctccagctctggatttatcccaaaccccatggagcccaggtgagccctcagtaactaccaatagaagattcgatttgacggttggtggcgtagggctaaattagtcactgcccccattaaaaatacagcggggggtttaagagcttttcacgccatgtgggaatcagcagcgaagccggctgatgccttgggtaaggagagaggcggcctaggggaccgtgaggtaatgaggtttatggcggtgacaaggcagccagggaaccccaccgactcccccctcaccccggccgcattgttctccggctggctctgtccctgctgctacggctgagagcccctcgtgactttgtgtggggagggggctggcagtggggaccctgaggcccttcctgggactggcattctttaccatcaggtggtattagggttggggagcagtgtagggttataaacctgtgcctcggagaactcactaaccccttccagaggaaaggtctggagctgggatgagacacttgcctttcaactgtgaggggccttagagggtctctgggaggcttgtatgaagtgatgcctgacaaagggctgcacacagagacctgtaagcagcatggtcatcaatgatggtgccaggcatcctgcaggagggcaccttttcagccaggagggcgcgatggaatcagcctctcatttggatttggctttggggagtgggcgaggtgactgaaagcctaaggttcattgctgctgtatttagatgtacaaattgtcagtttctagcggctctctgggcagaggaattttgcccaggctgggaaatggaccaggacccttgggccacaggcccctgtcatggaacacctgcccagagtgcccagaagcaggcaggtaagggtttcagtctcagtggagaaactgtcatgggagaaatcttctcgagttccccagccttaaagaacgctccttttaaattcacagttgtgtaatattgaacttttcacctgtttttcttccctcctaaggtgtgtgttcctagggatggaacctgtacctataaatattcagtaaataggaccaaaactcaaatccatcccttcctctactcatccattcagcaagtatttactgagctgcccccaggtgccaggcactgcacagggcactggggataaggagatgaccagcagatgtggtccctggcctcatggaggccacagtggcacaggcaagcatgccagtaaatgcatagccacacctggtcatgagtgccgtgatggcaaagccagaagctgccagggattaatggagggacccgtgtatgagacacaggggtgcattaaggaaggccttgctgaggcaggggcttgagacctgaagaaataagggaggtgggcagtccaagagcagtgggaagagaacactgcaaatgcagaagccgtgagctggaaacgagccagaagtacccttagagagctgtattcctatggagtttcaattctaggtggcttaaaacaatcccagagaagttcagaatcttgtccaagatcataccattcaggatagacttgcgactataacttgggtgcctcaccttccagcctggggtgtctgactccattgttaattttattataacaatcatgatgacaacgatgaataaagtgaaattgtactgtacaggaaa

SEQ ID NO: 23417 - DNA, 4911 bp, Homo sapiens
  ENST00000563137
ttttttttttttttttttttttgcataactcggctcggccgagtggcctccggactccccgcgccgctgggaccgccgcttggatcgggagccccggactgccgcattgcaacaggcagggccccggcgcgccccccgggcctccccccgccttcgagcggcctcggccggcccgggctgcccccccaagggaggccgccccggacctgcggtccgctccccacagccgccaaccgggctgcaaaaaaaaaagtttccaagagacaggcggaggagaagggggagaagggctgcccggagcggcggggggcggcggggggagccggctgcggagggcgacggagcgcccggagccccggacatgtccaggcggaagcaggcgaagccgcgctcggtgaaagttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagca

SEQ ID NO: 23418 - DNA, 4514 bp, Homo sapiens
  ENST00000562871
cacagggggcctcagaaatcgtcaggtggtgactggagctgagaggtggccactctgttaccatggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagc

SEQ ID NO: 23419 - DNA, 4201 bp, Homo sapiens
  ENST00000535559
accagtgggccggtgggaagcgcctctccagccctcgcctgccctgccgccgggtgctgggaacccgggctcaggttctggccctcttggcatcggccagtttgccctgggacgccctggtgagcagggggaaagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatattt

SEQ ID NO: 23420 - DNA, 4017 bp, Homo sapiens
  ENST00000567169
atccttcccgtctgccgagcccgtcatgtgaggcccccgggggagaaggtgctggtgctctgggagggtgttccaggaggccccttgagctgggctggggagctgggcttcagagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgata

SEQ ID NO: 23421 - DNA, 4018 bp, Homo sapiens
  ENST00000562520
ttttcccaagtcagaacccttcccgggcctgcccggagaccagagtctcagccggttcaggagctgcgggggacgcgcggcgccccctggcggctgggtaaaacctcgcagaaagtagcagctggtttatttcttctgacaactgcgcggggagggggtgctcctgcaaggtctcagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtga

SEQ ID NO: 23422 - DNA, 456 bp, Homo sapiens
  ENST00000568094
ttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggaggtaatgcaaaacagccccaggactctgacaggtggttacacgggtaattggacatagcaacagcttgaagcctcaagtgagattaaagaattaataatgtaattttacagttaatgtcattttattgtggtgtcttgggtaccctgtatccgccttttaaatacaattaaaaataaaagcaacagctttccggca

SEQ ID NO: 23423 - DNA, 4578 bp, Homo sapiens
  ENST00000262383
gaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgctggaagacaggaacagcgtgacaagtcaagaggagagaaatgaggatgatgaagacatggaggatgaatcaatttacacctgcgatcactgtcagcaggacttcgagtctctggcagacctgacggaccaccgggcccaccgctgtcctggagatggtgatgacgacccacaactctcctgggtggcctcgtctccctccagcaaggatgttgcgtcacccacgcagatgatcggagatggttgtgacctcggcctcggcgaggaggaagggggcacgggcctgccatacccttgccagttctgcgacaagtccttcatccgcttgagctacttgaagaggcacgagcagatccacagcgacaagctgccgttcaagtgcacctactgcagccgcctcttcaagcacaagaggagccgtgaccggcacatcaagctgcatacgggcgacaagaagtatcactgccacgagtgcgaggcagccttctcccgcagcgaccacctcaagatccacctgaagacccacagctccagcaagcccttcaagtgcactgtgtgcaagcgcggcttctcctccaccagctcgctgcagagccacatgcaggcccacaaaaagaacaaggagcatctggccaagtcggagaaggaagccaagaaggacgacttcatgtgcgactactgcgaggacaccttcagccagacggaggagctggagaagcacgtgctcacccgccacccgcagctgtccgagaaggcggacctgcagtgcattcactgccctgaggtcttcgtcgacgagaacacactgctcgcccatatccaccaagcccacgccaaccagaaacacaagtgccccatgtgccctgagcagttctcctcagtggaaggtgtctactgccacctggacagccaccggcagcccgactccagcaaccacagtgtcagtcccgaccctgtactgggcagcgtggcctccatgagcagcgccacacccgactccagcgcctctgtggagcgtggctccaccccggactccaccttgaagccgctgcgggggcagaagaagatgcgggatgacgggcagggctggaccaaggtggtctatagctgcccctattgttccaagcgggactttaacagcctggccgtgctggagatccacctgaagaccatccacgcggacaagccccagcagagccacacatgtcagatctgcctggactccatgcccaccctctacaacctcaacgagcacgttcgcaagctgcacaagaaccatgcctaccctgtgatgcagtttggcaacatctctgccttccactgcaactactgccccgagatgttcgccgacatcaatagcctgcaggagcacatccgcgtctcccactgcggccccaacgccaacccctctgacggtaataatgctttcttctgcaaccagtgctccatgggtttccttactgagtcctccctcaccgagcacatccagcaggcccactgcagtgtgggcagtgccaaactagagtctccggtggtgcagcccacgcagtccttcatggaggtctattcctgcccctactgcaccaactcccccatctttggctccatcctgaaactcaccaagcacatcaaggagaaccacaagaacattccactggcccacagcaagaagtccaaggccgagcagagcccagtctcgtccgatgtggaggtgtcttccccgaagcggcagcggctctcagcaagcgccaactccatctccaatggggagtatccttgcaatcaatgcgacctcaagttctccaactttgagagcttccagacccacctgaagctgcacctggagctgctgctgcggaagcaagcgtgcccccagtgcaaagaggactttgactcccaggagtccctcctgcagcacctgacagtgcattacatgaccacgtcgacccactatgtgtgcgagagctgcgacaagcaattttcctcggtggatgacctgcagaagcacctgctggacatgcacacctttgtgttgtaccactgcaccctgtgtcaggaggtcttcgactccaaggtgtccatccaggtgcacctggcggtgaagcacagcaatgagaagaagatgtaccgctgcacggcctgcaactgggacttccgcaaggaggctgacctgcaggtgcacgtcaaacacagccacctgggcaacccggccaaggctcacaagtgcatcttctgtggggagaccttcagcaccgaggtggagctgcagtgccacatcaccacacacagcaagaagtataactgtaagttctgcagcaaggccttccacgccatcatcctgctggagaagcacctgcgggagaagcactgtgtgtttgatgctgcgaccgagaacggcacggccaatggggtacccccaatggccaccaagaaagctgagcctgctgacctgcagggcatgctgcttaagaaccctgaggcacctaacagccatgaggccagcgaggatgacgtggacgcgtcggagcccatgtacggctgtgacatctgtggggcggcctacaccatggaggtgctgctgcagaatcaccggctgcgggaccacaatatccggccgggcgaggatgatggctcacgcaagaaggctgagtttatcaagggcagtcacaagtgcaacgtttgttcacggactttcttctcggagaacgggctacgggagcacctgcagacgcaccggggccctgccaagcactacatgtgtcccatctgtggtgagcgcttcccttcgctgctgacgctcaccgaacacaaggtgacccacagcaagagcctggacacgggcacctgtcgcatctgcaagatgcccctgcagagcgaggaggagtttattgagcactgccagatgcaccctgacctgcgcaactcactcacgggcttccgctgtgtggtctgcatgcagacagtcacttccacgcttgagctcaagatccatggcaccttccacatgcagaagctggcgggcagctcagcggcgtcctcccccaatggccaggggctgcagaagctctacaagtgcgccctgtgcctcaaggagttccgcagcaagcaggacctggtgaagcttgacgtcaatgggctgccctacggcctctgcgccggctgcatggcccgcagcgccaacggacaggtgggtggcctggccccgcccgagcccgccgaccggccctgtgccggcctccgttgccccgagtgcagtgtcaagtttgagagtgccgaagacctggagagccacatgcaggtggaccaccgtgacctcacgccggagaccagtgggccccggaaaggcacccagacatcgccagtgccccggaaaaagacataccagtgcatcaagtgccagatgaccttcgagaacgagagagagatccaaatccacgttgccaaccacatgattgaggaaggcatcaaccacgagtgtaagctgtgcaaccagatgttcgactccccggccaagctcctctgtcacctcattgagcacagcttcgagggcatgggcggcaccttcaaatgccccgtgtgtttcacagtcttcgtccaggccaacaagttgcagcagcacatctttgccgtgcacgggcaggaggacaagatctacgactgctcacagtgccctcagaagttcttcttccagaccgagctgcagaaccacacgatgagccagcacgcacagtgagggatcgctcaacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtattttttattgtcctgctacagctagtgtgcttttagactttccgccgcagactacatttctagagttagagaaacctgctttttaaggctattgtcctttgttccttcatgtattatattgatagtttttaaaaaagaattagtgtgattttttttctttgcttcttttttttctttcttgtttttcttcccccccaccccccacccccttcggttaactactttttaattgcaattctaggtaattgtgcatcgtgatgtgattgcttggctattgtctgaatatttccttttaattttttaattaaagactaatgctttgattggatttgccagttcaccggacagtgattaaaactatgtaatgaatataatcggtttcagtgcaactggatggtctgcttttaaatgtgacttaatctgactgcagtaactagtacagttcaataaagggaatccatgcgattagc

SEQ ID NO: 23424 - DNA, 10414 bp, Homo sapiens
  ENST00000277225
ggagagggagggagggagagagagagagagggagagagacggatatctcaggtcatctgcagctgcagcgagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatgggtaagagataccagtgagccccagaaagagcccaacttcagaaacatcacccacgattacaatgccaccaatggggctgagattgagctcaccctttctgaagatgaagaggattattatggctcctcaacaaacttgaaagatcaccaagtttccaatactgctctgctgaatacccaaactcccatctatgggactgagcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaactgctttgcataaaacagtcacctgtttcctagtacctcaaacttaaccaagggaactctctgcatttgtcagtactacctgtcgtcgttgtggttaaatgtagagagaactgctgggcaagatggtgaatggagaaaaaaaaagagttttaaagaaaggaacacaaattgtgcttaaaatccccatgtgggttttatttcttaaaatactgtgatttttttaattattttagtaaaaaacaaaacaaaaaaaagaaacagactttaattattagataactgtttgtgaattgtcatcctttattccaggtaagctgtttattagtgttcaactataatttagaatttggtagattcatgtgagctaattttaaggtgattgtggagttttgtttgccacatgtttattttctatcaatttgagtgttacaaacacagcacaattcagtttttcatatgaattgtttttcgtgtgtgtgttgttattgttgttttaatttcggggcaagggagatttagttttttgtgaataggaatgtttttattttaaacatggaaataacaaagaagttaactttcttttttttttttttttttttttttaatttaactaaagaaccaaactttcggcacagctatgcagcttgtgggccagacgaggaggtcctcctcacccttttgttgcctgtcaaattcacgcattatccgtctcataaataatttctgttaggattggctggcttttgtgtgtgattttaaaatctgtgttttgtttctgctggcattgtgttttgttgggggttttcatttatttaggggacgaggggatgtactagaatcccatccctttcgtgagagtggacaagaaataacatatcctacaaggagcctggagaactactttctttctttctttttttttttttttttttttttttaaatctagctgccagctgctctgtcccccatatcagctttttcaggagggagcagcttagactaaatctaagcctacatttataatatgttctgattgtgaacaaagggtttcgttccaaaaaatagaaaagaacttttcttgaagcctaggttttagaagcccgtgtgtgtgtgtgcttggatgtgtgtgtgcgtgtatgagtgtgtgtgtgcatgtgtgcacgtgtgaatcctttggttttcatgtttttttttttttttttttacttggaagggttgtgggagggtgggagggaagaaagggaaggggaattgctgagatgacagtgtcccacacagcttcaaataaaatccatggaaagatgttgcatttgtggaataagtgcttacttgaaaagcatgttcttcttttattttcttactgttaagaatttttatttgtaggatgtttgttttaatttaatttttttaagggatgggggccatcatgtggaaaccagaaaatggggaaagtgtgaactatccagacaaagattcattttgtgtctatatttgtttttaattggcctcatttcaaatgtattaaacagttccatacctggattgggtgtttgtaatggttaccaaaaaacaaacaaaaaaagaaagaaaaaggaaaaaaaaaaagaaaataattgtgacatgcttttatcactactttatttttcaaataacatgtaaatattgtaatccattggattttgttttgctaacctgttaataaaaatatgggaccattatccttttaacaaggctagaatgtcatttttttctttttcaaacatatacctgatattttgtggccgcacattttggatgcattattataattctgttgactgtaatgacatagaatttacaacattttttgttgttgtttaatttatacagaggacatttttttcagagcttgagagaagaaaataaatagcaaaatgataacctattgactccagtaatcagtgtttcccaatacttcataagagatagggagaccctgagtccttgaagccaagggtttaaaaacaaaacaaaaacaaaaaaaaccacaagtaggttattcaagttgtttgcaacatacattttgtaatgaaatgtgagaaattaataaagaatttttttcacatgtg

SEQ ID NO: 23425 - DNA, 551 bp, Homo sapiens
  ENST00000472574
gagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatgccttttggtcacttagaagaggtgccaaagatcaaggagaggaaagtggtg

SEQ ID NO: 23426 - DNA, 422 bp, Homo sapiens
  ENST00000480607
aacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgagccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggggctgcgttctcatga

SEQ ID NO: 23427 - DNA, 4828 bp, Homo sapiens
  ENST00000374686
cactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacag

SEQ ID NO: 23428 - DNA, 4691 bp, Homo sapiens
  ENST00000441147
atgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaagcaggaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttggg

SEQ ID NO: 23429 - DNA, 841 bp, Homo sapiens
  ENST00000497489
aacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggttggaccttcctcatctttctgttcagggaaaggtcgagtttcgatctggtttccttccacgcggatagtttggtggcagcagaaggtccaggattctcggtctaggaggcttcgggtcgtccttctattctgcgtttagtgccattagctcttcgttcttccaagttgcccgagctcttgagaggaatcaagaggcggatgaccctgcccacttgttcctggatggattggaagcagccaaagacgccagtggcgccctggtgggccgggtggatggtgaacactgcttgcttgatggaatgttggaggatgaaacccggccggggggataccattgcagtcaatgtgacagagtcctgatgtccatgcaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctg

SEQ ID NO: 23430 - DNA, 669 bp, Homo sapiens
  ENST00000469433
actaagctaaagcagaagcttggatgagtaagaaggccccactcatggttcacacctgctgctatgttacctggagcctcagtcaccttttctgtaaaatggggctgagaacaggagattgatcggatggcgttagatttggcaaatgcaggcattttaaaaatgagaattggaggaattgctatgatttacccaaagtttggatcgccatatgcaaacccaccacggacaccataaaccattccgatgcaaactctgctccttcaagtcctcctataacagccggctgaaaacacatatactcaaagctcatgctgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcct

SEQ ID NO: 23431 - DNA, 538 bp, Homo sapiens
  ENST00000471032
agaagcttggatgagtaagaaggccccactcatggttcacacctgctgctatgttacctggagcctcagtcaccttttctgtaaaatggggctgagaacaggagattgatcggatggcgttagatttggcaaatgcaggcattttaaaaatgagaattggaggaattgctatgatttacccaaagccgtgtaaaagagagataaatattcaataatgcgtttggacagtcttggataaagtttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtg

SEQ ID NO: 23432 - DNA, 701 bp, Homo sapiens
  ENST00000479166
aagaaggccccactcatggttcacacctgctgctatgttacctggagcctcagtcaccttttctgtaaaatggggctgagaacaggagattgatcggatggcgttagatttggcaaatgcaggcattttaaaaatgagaattggaggaattgctatgatttacccaaagtttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtggg

SEQ ID NO: 23433 - DNA, 1233 bp, Homo sapiens
  ENST00000427098
ggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgaggtaacctttctaacttggttttcttggatgcagcggggggcaggcagcagagatggccttctagggatgctctctcagagtggcagtagcacctgtgccttgttcctcaccttatcttcaggcaagaaaccacagtgataaccacagtgacagccaaaagggcaaaaacaccttcctgctgggagtatttcctccacctggagggaggcaaaggtgatggattctgcagtgaacatttccgtagggcttcccagcatgggggatttgtacattctgacaattctgccacccacagccttgcgtagactgcatagaaggaatgaacaagaaacaaaatgggtgggtgaaagcaaatgtgaaatgtggagagctctatggctgtgagagattctttcaagaagaccaaaatgatttccaaagcagaacatggaacttcccttgaaatggttgaagggagagagaattctttaaaataatgtatattatacattctaataatagtctctattatatattctaataataattagaaaatccatgggctttggatttaaattctggttttagagcccactgtgtttaacctctccatccattaaaagagatgattgtacctatgagataatgggtaaagtgtccagtggtttttcataatggatgcataatgactgctcaataaatgttggttcctgctgat

SEQ ID NO: 23434 - DNA, 655 bp, Homo sapiens
  ENST00000482115
gccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataagatgatttgcattataatgggaaaagcttgagctgtgtcatgtggagatctgagtcctaactaatcctggcttcatcacctacctgttttgtgatcttcatctacaaatatagaaggcaacacatttactgcacaatggtcgtaagggataagtgatacatgta

SEQ ID NO: 23435 - DNA, 676 bp, Homo sapiens
  ENST00000483287
ctgatataaatcatcacacaagggagagaataaatcggaaaaaataatgctcagattcctttggaatctcgggcaagcggctcttcagtcaagaaagacccagattttgtgatagaagcattggggaggtgaggcgaaatgaggtcttggggcccaagaaccagaaacagttctcgaatgctattcaaggaatgccctaagggggaaacctaagaaaaagtgaggaatctggaaattgctttcaccacatggctttatcagtgaaggtaggagagagggtatcctaatgaatgctgacttacctattctgctgattcccacagcacacaggtaacacttctgctttctctttgcagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggcc

SEQ ID NO: 23436 - DNA, 4871 bp, Homo sapiens
  ENST00000361524
aatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccatta

SEQ ID NO: 23437 - DNA, 4327 bp, Homo sapiens
  ENST00000584787
atttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaa

SEQ ID NO: 23438 - DNA, 4345 bp, Homo sapiens
  ENST00000399425
ggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgaggatattgtcttctctatgactgaagagaccagcgctcatgccaacactactgagatctggaatctcagcatagcttcaccaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccc

SEQ ID NO: 23439 - DNA, 4253 bp, Homo sapiens
  ENST00000538137
gacaatgatttcctcagtgattacgtacagagcgagtccctgcgggttaggggccccctctggagccatcctgatggctttgggggccttgcttccattttccattattatgtggactaccggagcgacagcgcagtccaagaccttgcagtttctttcagggctgaattgaaacaacttcagctgtttgcttttaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccat

SEQ ID NO: 23440 - DNA, 552 bp, Homo sapiens
  ENST00000577775
gcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgactccaaaacaaaggatctggc

SEQ ID NO: 23441 - DNA, 555 bp, Homo sapiens
  ENST00000577720
agtctctgcttcctcctccccaggttggcacacgaggggctgatggctcacgtcacaaagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggagg

SEQ ID NO: 23442 - DNA, 694 bp, Homo sapiens
  ENST00000577801
ctgggggccgtcggctcgggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatga

SEQ ID NO: 23443 - DNA, 531 bp, Homo sapiens
  ENST00000581869
attgtcacttagtgatttactggctctgtcatgatttagacattgaacttctgactccaagtccagtgttggtttgctacaattgtttcatcaagatgggaaagctatggaccagaaaaggcaaataacttgtccaaagtcacgtaaatatgaataatgaagctcgggtttcaacttaggcatcctgcctccagattccatgcccttaactcctataccagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcag

SEQ ID NO: 23444 - DNA, 547 bp, Homo sapiens
  ENST00000580488
gttcgcatctgcctcggatggtgggagatttttctttccaagaccttttcatcgccttgcagggtcgatttccccccctcgtccccccaactacaaaagagcacgactcgctttgatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactg

SEQ ID NO: 23445 - DNA, 541 bp, Homo sapiens
  ENST00000583005
gagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaaggtgtgggacttctaaatatgtcacgaaacctagaaggctagttaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaag

SEQ ID NO: 23446 - DNA, 594 bp, Homo sapiens
  ENST00000579111
atgcccctctgtctgtgtgtgagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagagtatttccatatcctttaaaaaccactgtagttatccttactgacagcagtgacgtctaacagtgatgacagaatttttcaactttttgcttccgaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaagg

SEQ ID NO: 23447 - DNA, 406 bp, Homo sapiens
  ENST00000583398
gattctcctgtaataaaatctgcaatgaagccctcctattgcaacttcaaggaaaatggtgtttctgtttttggtagcaagaagattaaatgttactttaaaagaacctgtctttaaaccccatacttacagtgttgatatttttcagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttccccta

SEQ ID NO: 23448 - DNA, 590 bp, Homo sapiens
  ENST00000582584
gatttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagggtgacgcacattccttggagagcctgccttgatgaaaacctattcactccgtatcaaaagtcttgaaactgagccaaggccaaacgaagcctttggagatgaaggtcaaatacagaagaacaagatgatcaattctagacccagatttgaaagtcagctataagattatgtgccaggtaaaataatgattagctgtccacgtggactgaaattttagacagtggatcctgcagggataaagaaaatgcgagctcacacacacct

SEQ ID NO: 23449 - DNA, 338 bp, Homo sapiens
  ENST00000577461
gggaaagtttggtgcagcagccgccgccgccgccgccgccgtcgtgcagagcgcggagctcgggcagccgcgagccccgcgcgcgagcgcgagccggagccggagcgaggagcggagcgcggagcgagggcgcgagggaggccgagcggagggcgcgaggcgccgcggcccgaggggcgcgcggccacgaggaagtatagtttctttcagggctgaattgaaacaacttcagctgtttgcttttaggatgtctcgccgcaagcaagcgaaaccgagatccctcaaagaccccaactgtaaacttgaagacaagactgaagatggagaggcactagatt

SEQ ID NO: 23450 - DNA, 1539 bp, Homo sapiens
  ENST00000513985
cagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagataaagtcgcaaatggagacatttattttcataatgctaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaataatg

SEQ ID NO: 23451 - DNA, 4726 bp, Homo sapiens
  ENST00000504926
gtgagcagcggcggcagcggcaacccaaacagcaatagtaccagcaccagcacctctgccgccaccgcgggggcaggctcctgtgggaaaagcaaagaggagaagccaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaccaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaata

SEQ ID NO: 23452 - DNA, 5958 bp, Homo sapiens
  ENST00000306315
aaaaggtgattatccttgtgttgttgataaagggattttctttttagctaccgtaagatgcttactgtcataggtttatttttcgggtttggttattttcctttaaacctgatattggactgtgaggacaatacatgagccaccttactctccatccttccctgtcccctttactgattccccaatactaatcgttttttattctggtaacacccagacaagaaatattcgacttttcccccccccttcacaggaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaccaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaat

SEQ ID NO: 23453 - DNA, 2686 bp, Homo sapiens
  ENST00000505686
tttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctgcttgacctctgctgcccttgttgcctctcagcaggtggctgcccaggcatctgcatctggaatgtttcctggacaaagaagataaagtcgcaaatggagacatttattttcataatgctaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttg

SEQ ID NO: 23454 - DNA, 801 bp, Homo sapiens
  ENST00000503896
ggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgct

SEQ ID NO: 23455 - DNA, 2605 bp, Homo sapiens
  ENST00000509799
cactccccctgtgtgtgtgttgtgtttcagtcctgatttagtgttgcagaacaagcttgttgtgtgtgtgcaccagggggatttttgttttgctttttttaaattttaatttttgcttttataaaaaatacacaggacggtctgtgacatttgatggtccatcttctttaataataaatttgttgaagagattataatttccaaaataaagcggctgcaaccaaacacattcaatgcagttagaaggaaaaggtcaactcgatccaatacagaccgaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaa

SEQ ID NO: 23456 - DNA, 2737 bp, Homo sapiens
  ENST00000513986
cgcctgtaggtttgctacatgggatcattactgatcacggtgactctgaagtctggaactgaaggcggaatgagaagttgggaaaacttttttctctaaactctctgttttttaaaaaactattattctcgatgcttgttaagaggaaaaaaaaacctttggtgcttctgttgtgaatgtgaaacattattttccagctgtacagtgacacattttttttaaggagaaaaggactgattcgtttgccaaaaggggggtggggaggtggaataatgttatcgagtgattattctggctgagatgtgttatttggtttcttccttcttgatcatttggtgtttaagtaaaatgaggcacaggcttgtttgccgagtggagtgggaaaggcattttgatttgctggcctaattaaaaaatgataaaggattaaaaggaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgac

SEQ ID NO: 23457 - DNA, 413 bp, Homo sapiens
  ENST00000511308
gttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaagtatttcagctagtacaagggaagtgcctattagaagcaatgggccgcttgaggacatggattgcatccagtagtggcgcattcaccaaaaggcagatgaaaataatctgtaccaacaaggatcacaacaggaaacatcatctgaattttccactatt

SEQ ID NO: 23458 - DNA, 570 bp, Homo sapiens
  ENST00000512940
aaacacactcatttgcggtcattgaggccaccttggcgcagatcacttaaagtgaaaaggtggacctggactgagggtgtaaaatccctggacacattcgtggggcaggaaaaagaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaactt

SEQ ID NO: 23459 - DNA, 3190 bp, Homo sapiens
  ENST00000613878
agaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaat

SEQ ID NO: 23460 - DNA, 4659 bp, Homo sapiens
  ENST00000333190
cccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcagagactgaaagaattaaagcaacgggaatttgctcgaaatgtagcttctaagtcatggaaagatgagaaaaaacaagaaaaagcacttaaacgacttcatcagctggctgagttaaggcagcaatctgaatgtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaa

SEQ ID NO: 23461 - DNA, 3968 bp, Homo sapiens
  ENST00000611114
ggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcagagactgaaagaattaaagcaacgggaatttgctcgaaatgtagcttctaagtcatggaaagatgagaaaaaacaagaaaaagcacttaaacgacttcatcagctggctgagttaaggcagcaatctgaatgtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaataagtgttaaagcccctcctgtgga

SEQ ID NO: 23462 - DNA, 10953 bp, Homo sapiens
  ENST00000637017
acatttcagatgtgaacatcctgtctcaccaaaacaaccccagctaagaagttccgtcgggggtggaggactttttccaagcctttgtttctgtggagtctctgtgcatggcctgctgtgatgagcagtcggtttttctctagagaaggcataaagagaagcagaggcagagatgggacgagcagggagaatgctcctgcctcatcggagccaccggttttcgggagagagcggcagcccccacctgcctgtggactgagcacttaaagggctggtgatgatcaacctcttctgacaatggagagagcatgcggtggatgttaggggaaccaaaccccaagagggaaccagcttcagtggaaagcggagtgcgtgcctccccgaggcagggcattgctgagccccagagaggagccctgggttccgctgcctcccccacaggacaaggcatgacagcacctgcattggaatatagactgtgctttggagcctttggcatcagcttccacctggtgcgtaagtctgtggtctctccagcaagttcagggaagtgagggagtcgcagttctctgtcattcagcaggtgtggactgagggctggctctgtgccaggccctgtgctggatgctgggttccattgtgaggccaggcacagccaaggcagagacgaacattcctacagtcgctcacgacaccaagctccacagaccagagaatggacggatccacaggaacgaaagacaggctgtcaggtgcccagccctggggagactccagaagaggagagaggaccacccatcatggctgaccttgggaggacttgggtcttcacaaattgtgttccttggtatatataagagggttaaaatagacacaagaaatatccatctattcccattcatttatttgacacatactcttggggccatgagttcaattcccagaagaggatcatgatggtggggggaggaaggatgtggcgaggggccgtgcaggagcccagggggcttgtctcatggacgctcttgatcgaattcctctgaggccccagaggtgctccttcatccccagcttgcttgtgaggctgcgttggctccccaaggccgagtttcctgctgagacccagccacacacttagccctgagtgtaccaggtggctccactcagagcgctgctccagcccctctccctggggcttcctgccacgtgactgcacatttggggtctggagaagggcccagggactgaactgcaaaggtgaagggtgtccctgctcctcctgaccacagcttctggactggcatgtgtgtctgatggtgcaagaccagaggggcatggccaatgagagagttattctttctacccgtgagtctccctcggacacacaggatttctcatgtctcctcctggttttgctgctttttttttttttttctagctgcatgaggtagttttgtttgaaagaatagtcaatgcagactgcagttttccgaatgaggcttgctcttggcaagttttccagcattgtgggccatccagatgatgcggaatggaggttccagaacccacctgccctgcccctcctgcgagggaccagccagctcccactcctggccctccaggggccccaggtggccaggcctcacctcacctgaccctgggccctgtccttctgccgccagagcagggcctggccccccccactgtgttcctgaaggccctgcccatcccactgtaccacacggtgcctcccgggggcctccagccccgcgccccgctagtgacgggcagcctagatgggggcaacgtgcccttcatactcagccctgtgctgcagcctgaagggcctggccccacccaggtggggaagccggcggcccctacgctgacggtgaacatcgtgggcactctgcctgtcctgtcgccgggcctgggccccacgctgggcagcccaggcaaggtgcggaatgcgggcaagtacctgtgtccgcactgtggtcgcgactgcctgaagcccagtgttctagagaagcacatccggtcccacacgggtgagaggcccttcccgtgtgccacctgcggcatcgcctttaagacccagagcaatctctacaagcacaggcggacgcagacgcacctcaacaactcccggctgtcctcagagtccgagggcgccgggggcggcctcctggaggaaggggacaaggccggagagccccccagaccagagggcaggggcgagagcaggtgccaggggatgcacgaaggcgcctcggagagacccctttctccgggtgcccacgtgcccctacttgccaagaacctggatgtgaggaccgaagctgctccctgtccagggtccgcatttgccgacagagaggctccttgggactctgcccccatggcgtcacctgggctcccagcggccagcacacaaccctggcgtaagttgccagagcagaagtcgccgaccgccgggaagccgtgcgccctgcagcggcagcaggcgacggcagcggagaagccctgggatgccaaggcccccgagggccggctgcggaagtgtgagagcaccgactcggggtacctgtcgcgctccgacagcgcggagcagccgcatgcgccctgcagccccctgcacagcctttcggagcacagcgccgagtccgagggggagggcggcccgggcccggggccaggggtcgcaggggccgagcccggggcgcgagaagccggcctggagctggagaagaagcggctggaggagcgcatcgcccagctcatctcccacaaccaggcggtggtggacgatgcccagctggacaacgtgcggccccggaagaccgggctgtccaaacagggcagcatcgacctgcccacgccctacacctacaaggactccttccactttgacatccgcgcgctggagccaggccgtaggagggccccgggccccgtgcgctccacctggacgcccccagacaagtctcggcccctcttcttccactccgtccccactcagctctccaccaccgtggaatgtgtccccgtcaccaggagcaactcgctgcccttcgtcgagggctccaggacgtggctggagcccagggagccccgggacccctggtccaggacgcagaagcctctgagccccaggcccggcccagcccgcctgggctgccgctcgggactaagctcgactgacgttcccagtgggcatccccgggccctggtcagacaggccgcggtggaggacctgccaggcacccccattggcgatgccctggtgcccgcagaggacacagacgcaaagagaactgctgcgcgggaggccatggccggcaagggcagagcgggcggcaggaagtgcggccagagaaggctgaagatgttctcccaggagaagtggcaggtgtacggggatgagacgttcaaaaggatctaccagaaaatgaaagccagtccccatggaggcaagaaagccagggaggtgggaatgggcagtggggcagaactgggctttcctctgcagaaagaggcagcagggagctcaggcacagtccccacccaagacaggaggacccctgtccatgaggacatatccgcaggggcaacgccagagccttggggaaatccaccagccctggaggcctccttggtgactgaacccactaagcatggggagacggtggccaggagaggagacagtgaccgacccagggtggaagaggctgtgtcatcccctgcactgggtggcagagacagtccctgttcaggcagtaggagccccctggtctctccaaatgggaggctggaactggggtggcagatgcccccagcacctggccccctcaaagggggtgatgtagaggctcccaggccagtttggccggaccccaagctggaaggaggtgcccgaggtgtgggggatgttcaggagacctgcctgtgggcccagactgtcctgagatggcccagcaggggctcaggggaggacaagctcccctcagagaggaagaagctgaaagtggaggacctgcacagctggaagcaaccagagcctgtgagcgcagagaccccaggtgggcccacgcagcctgcctctttgtcatcccagaagcaggatgccgatcccggggaggtgccagggggctcaaaggagagtgccaggcaggtgggcgagcctctggagtcctctggagcctccttggctgctgcttctgttgccctgaagagggtggggccaagggacaaggctaccccactgcatcctgcagccccagcccccgcagagcacccctcgctggccaccccacctcaggctcctagagtgctctctgccctggcagataatgccttttcccccaagtacctcctcaggttacctcaggcagagacccccttaccactgcccattccctggggaccaaggcacagccaggactctctctgcagcagtgggtggcctgaagaacgggcatcatttgttgggtcaggactggggacccctctttctcccagcccagcctcaggcccctccccaggtgaggcggacagcatcctggaggaccccagctgttccaggccacaggatgggagaaaaggggcacagttggggggggacaagggggacaggatggccactagcaggccagcagccagggagttgcccatctcagcaccaggggctcccagggaggctacctcctccccgcccactccaacgtgtgaggcacacttagttcaggacatggagggtgacagccaccgtatccatcgcctctgcatgggcagcactttggcaagggccaggctctctggggatgtcctgaatccctgggtacccaactgggagctgggggagcctcctgggaatgccccagaagatccttcttcagggcccctggtgggccccgacccgtgttcccccctccagcctggctccttcctcactgccctcactcggcctcagggtgtgcccccaggctggccagagctggccttgtcttcccactcagggacgtcccggagccacagcacccgcagtccccacagcacccaaaacccctttccctcactgaaggctgagccgcggctcacgtggtgttgcctgagccgcagtgtccctctgcccgcggagcagaaggcaaaggcggcatctgtgtacttggcggtgcactttcctggtagcagcctccgagatgagggtcccaatggccctcctgggagcaatggaggatggacctggacaagccctggagaaggagggccggcgcagatgtccaagttctcctacccaacagtcccaggggtgatgccccagcaccaggtgtctgagccagaatggaagaaaggcctgccttggagggcaaagatgtctcgtgggaacagcaagcagagaaaactgaagatcaaccctaaaaggtacaaagggaatttcttgcagagctgtgttcagctgagagccagtagacttcgcacaccaacctgggtgcgaagaagaagccgccaccctcccgcacttgagggactgaagccatgcaggacccctgggcagacctcttcagaaatagcaggtctgaatctgcaagaggagccatcttgtgccacctcagaatcacctccttgttgtgggaaggaagagaagaaggaaggtgactgcagacaaaccttaggaaccctctctcttggtacaagttcaagaattgtcagggaaatggacaaacgaactgtgaaggatatttctccatctgctggtgagcatggtgactgtactactcacagcactgctgccacatcaggattatctctgcaatctgacacctgcctggcagtggttaatgacgtgcctctaccccctggcaaaggtcttgaccttgggttgctggagactcagctgctggcctcccaggattcagtctcaacagatcccaaaccatacatcttctcagatgctcaaaggccttcttcctttgggtccaaaggaacttttccccaccatgacattgctacctctgtggctgccgtttgtatttctctgccagtgagaacagatcacatagcccaggaaattcacagtgctgaatcacgagaccacagccagactgcagggaggactctgacatcaagctccccagacagcaaagtcacagaagagggcagagcacagaccctcttgccagggagaccttcatctggacaaagaatttcagattcggttccactggagtcaactgaaaaaactcatcttgaaataccagcttcaggaccaagttcagctagttcacaccacaaggaagggagacacaagacgttttttccttccagaggccagtatgggtgtggggaaatgactgtcccctgcccctctttaggaagtgacggtaggaaacgtcaggtatctggattaatcactcggaaagattctgtggttccttctaagccagagcagcccatagaaattcctgaagccccttctaaatccctcaagaagaggagtctggaaggaatgagaaagcaaactcgagtagagttcagtgacaccagcagcgacgatgaagaccgattagttatagaaatatgaagcttccagagaaacatggtgtctggtcaaaaagactgttgacgcttcacaagtaaatgttgtcaggctggcggaagaactaaactctatctgtgaaacacctacagattaggaaagccattttgagttatttacaagccaactccaaccaacttctgacccccaactcagccgcagcgttccccagctccccttgggagtgctctgctcatcttcaaatggtgccaggcagggcagacatggcaaggaagcaaactctgcaaatggtcaacgtgcacagtgactgggccttgactcccagcctcgtcttctgcacctgtcccccactgcctctctgcaatcaaatggcactaaccaagaaagccaccatcaacacatttctccacaagtggaccccacacagtcgaggcaactggctttctccattagtaaactgaggatttgcttccaaggtggagagcacacttgggataattggagtagcttgacaaagagacgggggtgtgaactgggcacaaagatacttctgttcattttggagacaaaattcagatacattaaaaaactgaagcttgttcagagtaattcacgtccttggtggagttgtaaatacacttcaaaatgcctatgatccggtgacatgctgattacttttaaatgttgcacaaatggtcaatgcttatttatggtcagatgatgcaagcacatgctcttgtgcctggtgcgtttgctgtggagatctctgagactgtcggtttttctagttcttgcaaaggaacggtgttaaaagttaatagaactgtctctctgtaatgagtcattttttgagagggaaaaattcacttattttcctctgattcttcttgtcatattgtgctctgagcaatttcaattagagggttacattttagtaatctgtacagcttcaactgatgcctgctcgtcgtgacgggagccttttagatttccttcagaagcttcaaggatacaaaactaattggagttttgacgctgttttacatctcggtaattttattttcggggcttagtgttactttgctgtcaaattaaatcagcctctgtattgtgcacgtcagaactgcacagagaaaattccccagtattccaagccggtgcgcccctgtgcagaagaaaacagatctacgtcagccagcccggggggcaaagcctcagttccactgccttcctctccctctccttccacgggagaggagaaacttaaagaggtttacattgctgcatttcaataaaattttatacttgcttttggtatgattttgtacaatttgaaatttgtagctgagctcttttggtgtaactttgatgtaatgatgttcatatgacatcttgtacttcagagacacagcagcaatgcagagcatctcacacatgtgaatacacttcagtcagtctgtgcctgtgactaagtatggtcaaatttcaagtatcttcatgtgaattttccaattttggtgtttttcatagaaaacttcaatgccagaccagcttccctggttacttagcatatatttgtgaccatttcatatgcactcataaatatccaaggatttcaggcccagccaagaaaaacataagaagggaggtaaaaaggatgttggacattgacttagtgtactttttaaacccaacaaaagcgatgtggtgattatctcccttttcgaaggattcatgccactgtaatgagagaggcagtgtaggcaaatggtctgagccttggatggagattgaagtcctgactttagctgggaaatcttggttaagagtctttctgtaccttagtttccctaagtgagaataagagagttggacaagacgaatgtatctccaggttccaatttttctgagaatggttgatagagaagctgctctctccttaaaatgcatggactcaatggcttgaagatattccccatggggaaccattgccacggaggccttgcatgcaagaagtttgggtggggacagtgaggaactgaaacacaagcaccttccaccaattattgctgtgaagaacctgagcctgaagaagctccatctaattttttccccagagttccagattttagggtgcaatcatccagcctatacatgtggctcatagttcaaaaaattaaaagcaaaaccagaactctccagtaggaatggagaaaacctatctgtaggctgaactggctcctttgtcttaggaggcactggtcaggggaaaaaagctgtcttccagacccctcctttctgggtggctactgtggaatcaacggggtcactggctgtaaatcagtaagtcatagctccaaacagcaccaacttcaggatgatggtggaagctctgtccctataggagccaccgttgccagctgtcacatcccaacctaggtcaaatatggcggaatattgatttcgtctctaactccctgtatctcttacaaaggtaaagcaggtagcgaagccaccttgcttccctggtctttgcctagtggctggcaatgtttacaagtgtaccttactttatatcaacatgaatttgtgaaaaagctgtatgtcaatggattttttaaaaattaaaaatgtattttgaatgaccctaagggagctggctctttaaaagcatcctaaggtaaagattttttttaaatgaagaatctttttataaagcaatgaacaatctctgattttataaatcttaattttcctatgggttttcttaaagtgaaatacaattataagaatacattttaagggtaacattaacaacctagaacccagtttgggttactaaaaataaaatgtcagtattatcaattgataactaccacagttttatactctgcaagtgtgtactgcatgatggttaaggaaaaacaaatttattttagaacaaagcaaaccagagtttaaagatcagggatttccttctttccccagtgctaattttcccagtgttaattttattatatctttaggtaagggtcttaaccaactgatgcctcagtttcttccacagagaatagttagagggatgctgtcatgaactaagggaagggcactgaatttttttttgccaatatcaaaagtgacatttccccatgatgttcaagactcaccaggtttctctctccacctgtacctacacccagctagatcttgtcgttaaagatgtatggagggaagaggtttcaatccttccctccttggcaacctacattgttaagtgactcaaagtcatgtgatttttggtggacaactggaatcctccttcttgtaaaacacattgaaaaacagctcatctctcctgttaggcttaacccttgagatttgagacaaagctaataatcccctttggttcacatctcacagtaaccaggagaacctatggttcatttgccaagtgattaaaaaaaaagatggaggagggtgtctctgaattttaatggaaacactgccaatagcatggtgggtaacctagggcaagacagactttttcttcctgaaatcactcttctaaagctgagaccggaagaggaaccttgcagaagtgcactgtgaccacagttcttggcatgaaagataaacaatttgcagtctcatgccaaaaagtatttccttgcatttacattcattacttagaatgatcacattattcatttttttccccagcacagaaatttgcattttgcacagaatttgcctggtgcagcagatctttatagttatggaaactgtcatcattatcggaatgtgctgctgctcaactccccagacataatttaatatggtgaggagaatatgacctgcctggctctatgggtgatcatatttctactgctgcagcaagctgggcttgtgtatttttcctcacttcagttgttcttcccatagttcatgtagggaggcactttggcttttgaaacactacatttctcaatatttaagcacaatttattgtccttatttttcagaacccattaaatataagggtcagaacctagaaaatcttatgtgctggatttctaccctgtatgattcttttcatccatgctttgcacttacgtaggaatatacataatttggtctgaagaagtataggaacagttgagcacattacttcaccactggaagaataggaaccagggaaaaacatcagcctctgccacttggagcactagaggatgacggaatgtcttgtatatgcggtcaactgttcaggatttactactcaattggttgttcacaatcagggaaatgattggcttcttggttgtttgttgaactttctttctttatatggttaaattattttgttttgataaaaataaaacttaaaatgcaaa

SEQ ID NO: 23463 - DNA, 898 bp, Homo sapiens
  ENST00000610729
tctcaccaaaacaaccccagctaagaagttccgtcgggggtggaggactttttccaagcctttgtttctgtggagtctctgtgcatggcctgctgtgatgagcagtcggtttttctctagagaaggcataaagagaagcagaggcagagatgggacgagcagggagaatgctcctgcctcatcggagccaccggttttcgggagagagcggcagcccccacctgcctgtggactgagcacttaaaggtgagagaggactttgtgatttctttgtgcacctggagttctgggatgcaaggccagatgaagggatcttaatcattgagcctggtctgttgcctcccgagtgattctatcaggcaagcatgatggatgattccttccaagcacacgcagttatctctgacacgagccccactcaggtccccttgagatctcttgaaccaaggggcttctagcccctcctcctcacctttcagcacagccttgtaaacctcagatgtggatgaaggtgccgtcctgcctttgacttgacctgttgatttccaaccggggctgctggcccttcctctctagagtgagtagtgactcacacttttggggccctatgaaatggtcctccatccaaggggctttgggaagcctgtttccctggtggccccaagcccagtaaccaaaagcaatcagacccagctgtccagctaatttttttaaaataggcttccttcctagtagaaatcaacaaagtctaaaatagaagggactctaataggaaatgaagctgcagagttctgtgtggaatgcaacaggcagggacctcggcatggaaaatactaagtgcagattacatggctgacaaccatgggagcaggagaaggagtaatctccttgcttatcg

SEQ ID NO: 23464 - DNA, 9401 bp, Homo sapiens
  ENST00000371030
atggaggttccagaacccacctgccctgcccctcctgcgagggaccagccagctcccactcctggccctccaggggccccaggtggccaggcctcacctcacctgaccctgggccctgtccttctgccgccagagcagggcctggccccccccactgtgttcctgaaggccctgcccatcccactgtaccacacggtgcctcccgggggcctccagccccgcgccccgctagtgacgggcagcctagatgggggcaacgtgcccttcatactcagccctgtgctgcagcctgaagggcctggccccacccaggtggggaagccggcggcccctacgctgacggtgaacatcgtgggcactctgcctgtcctgtcgccgggcctgggccccacgctgggcagcccaggcaaggtgcggaatgcgggcaagtacctgtgtccgcactgtggtcgcgactgcctgaagcccagtgttctagagaagcacatccggtcccacacgggtgagaggcccttcccgtgtgccacctgcggcatcgcctttaagacccagagcaatctctacaagcacaggcggacgcagacgcacctcaacaactcccggctgtcctcagagtccgagggcgccgggggcggcctcctggaggaaggggacaaggccggagagccccccagaccagagggcaggggcgagagcaggtgccaggggatgcacgaaggcgcctcggagagacccctttctccgggtgcccacgtgcccctacttgccaagaacctggatgtgaggaccgaagctgctccctgtccagggtccgcatttgccgacagagaggctccttgggactctgcccccatggcgtcacctgggctcccagcggccagcacacaaccctggcgtaagttgccagagcagaagtcgccgaccgccgggaagccgtgcgccctgcagcggcagcaggcgacggcagcggagaagccctgggatgccaaggcccccgagggccggctgcggaagtgtgagagcaccgactcggggtacctgtcgcgctccgacagcgcggagcagccgcatgcgccctgcagccccctgcacagcctttcggagcacagcgccgagtccgagggggagggcggcccgggcccggggccaggggtcgcaggggccgagcccggggcgcgagaagccggcctggagctggagaagaagcggctggaggagcgcatcgcccagctcatctcccacaaccaggcggtggtggacgatgcccagctggacaacgtgcggccccggaagaccgggctgtccaaacagggcagcatcgacctgcccacgccctacacctacaaggactccttccactttgacatccgcgcgctggagccaggccgtaggagggccccgggccccgtgcgctccacctggacgcccccagacaagtctcggcccctcttcttccactccgtccccactcagctctccaccaccgtggaatgtgtccccgtcaccaggagcaactcgctgcccttcgtcgagggctccaggacgtggctggagcccagggagccccgggacccctggtccaggacgcagaagcctctgagccccaggcccggcccagcccgcctgggctgccgctcgggactaagctcgactgacgttcccagtgggcatccccgggccctggtcagacaggccgcggtggaggacctgccaggcacccccattggcgatgccctggtgcccgcagaggacacagacgcaaagagaactgctgcgcgggaggccatggccggcaagggcagagcgggcggcaggaagtgcggccagagaaggctgaagatgttctcccaggagaagtggcaggtgtacggggatgagacgttcaaaaggatctaccagaaaatgaaagccagtccccatggaggcaagaaagccagggaggtgggaatgggcagtggggcagaactgggctttcctctgcagaaagaggcagcagggagctcaggcacagtccccacccaagacaggaggacccctgtccatgaggacatatccgcaggggcaacgccagagccttggggaaatccaccagccctggaggcctccttggtgactgaacccactaagcatggggagacggtggccaggagaggagacagtgaccgacccagggtggaagaggctgtgtcatcccctgcactgggtggcagagacagtccctgttcaggcagtaggagccccctggtctctccaaatgggaggctggaactggggtggcagatgcccccagcacctggccccctcaaagggggtgatgtagaggctcccaggccagtttggccggaccccaagctggaaggaggtgcccgaggtgtgggggatgttcaggagacctgcctgtgggcccagactgtcctgagatggcccagcaggggctcaggggaggacaagctcccctcagagaggaagaagctgaaagtggaggacctgcacagctggaagcaaccagagcctgtgagcgcagagaccccaggtgggcccacgcagcctgcctctttgtcatcccagaagcaggatgccgatcccggggaggtgccagggggctcaaaggagagtgccaggcaggtgggcgagcctctggagtcctctggagcctccttggctgctgcttctgttgccctgaagagggtggggccaagggacaaggctaccccactgcatcctgcagccccagcccccgcagagcacccctcgctggccaccccacctcaggctcctagagtgctctctgccctggcagataatgccttttcccccaagtacctcctcaggttacctcaggcagagacccccttaccactgcccattccctggggaccaaggcacagccaggactctctctgcagcagtgggtggcctgaagaacgggcatcatttgttgggtcaggactggggacccctctttctcccagcccagcctcaggcccctccccaggtgaggcggacagcatcctggaggaccccagctgttccaggccacaggatgggagaaaaggggcacagttggggggggacaagggggacaggatggccactagcaggccagcagccagggagttgcccatctcagcaccaggggctcccagggaggctacctcctccccgcccactccaacgtgtgaggcacacttagttcaggacatggagggtgacagccaccgtatccatcgcctctgcatgggcagcactttggcaagggccaggctctctggggatgtcctgaatccctgggtacccaactgggagctgggggagcctcctgggaatgccccagaagatccttcttcagggcccctggtgggccccgacccgtgttcccccctccagcctggctccttcctcactgccctcactcggcctcagggtgtgcccccaggctggccagagctggccttgtcttcccactcagggacgtcccggagccacagcacccgcagtccccacagcacccaaaacccctttccctcactgaaggctgagccgcggctcacgtggtgttgcctgagccgcagtgtccctctgcccgcggagcagaaggcaaaggcggcatctgtgtacttggcggtgcactttcctggtagcagcctccgagatgagggtcccaatggccctcctgggagcaatggaggatggacctggacaagccctggagaaggagggccggcgcagatgtccaagttctcctacccaacagtcccaggggtgatgccccagcaccaggtgtctgagccagaatggaagaaaggcctgccttggagggcaaagatgtctcgtgggaacagcaagcagagaaaactgaagatcaaccctaaaaggtacaaagggaatttcttgcagagctgtgttcagctgagagccagtagacttcgcacaccaacctgggtgcgaagaagaagccgccaccctcccgcacttgagggactgaagccatgcaggacccctgggcagacctcttcagaaatagcaggtctgaatctgcaagaggagccatcttgtgccacctcagaatcacctccttgttgtgggaaggaagagaagaaggaaggtgactgcagacaaaccttaggaaccctctctcttggtacaagttcaagaattgtcagggaaatggacaaacgaactgtgaaggatatttctccatctgctggtgagcatggtgactgtactactcacagcactgctgccacatcaggattatctctgcaatctgacacctgcctggcagtggttaatgacgtgcctctaccccctggcaaaggtcttgaccttgggttgctggagactcagctgctggcctcccaggattcagtctcaacagatcccaaaccatacatcttctcagatgctcaaaggccttcttcctttgggtccaaaggaacttttccccaccatgacattgctacctctgtggctgccgtttgtatttctctgccagtgagaacagatcacatagcccaggaaattcacagtgctgaatcacgagaccacagccagactgcagggaggactctgacatcaagctccccagacagcaaagtcacagaagagggcagagcacagaccctcttgccagggagaccttcatctggacaaagaatttcagattcggttccactggagtcaactgaaaaaactcatcttgaaataccagcttcaggaccaagttcagctagttcacaccacaaggaagggagacacaagacgttttttccttccagaggccagtatgggtgtggggaaatgactgtcccctgcccctctttaggaagtgacggtaggaaacgtcaggtatctggattaatcactcggaaagattctgtggttccttctaagccagagcagcccatagaaattcctgaagccccttctaaatccctcaagaagaggagtctggaaggaatgagaaagcaaactcgagtagagttcagtgacaccagcagcgacgatgaagaccgattagttatagaaatatgaagcttccagagaaacatggtgtctggtcaaaaagactgttgacgcttcacaagtaaatgttgtcaggctggcggaagaactaaactctatctgtgaaacacctacagattaggaaagccattttgagttatttacaagccaactccaaccaacttctgacccccaactcagccgcagcgttccccagctccccttgggagtgctctgctcatcttcaaatggtgccaggcagggcagacatggcaaggaagcaaactctgcaaatggtcaacgtgcacagtgactgggccttgactcccagcctcgtcttctgcacctgtcccccactgcctctctgcaatcaaatggcactaaccaagaaagccaccatcaacacatttctccacaagtggaccccacacagtcgaggcaactggctttctccattagtaaactgaggatttgcttccaaggtggagagcacacttgggataattggagtagcttgacaaagagacgggggtgtgaactgggcacaaagatacttctgttcattttggagacaaaattcagatacattaaaaaactgaagcttgttcagagtaattcacgtccttggtggagttgtaaatacacttcaaaatgcctatgatccggtgacatgctgattacttttaaatgttgcacaaatggtcaatgcttatttatggtcagatgatgcaagcacatgctcttgtgcctggtgcgtttgctgtggagatctctgagactgtcggtttttctagttcttgcaaaggaacggtgttaaaagttaatagaactgtctctctgtaatgagtcattttttgagagggaaaaattcacttattttcctctgattcttcttgtcatattgtgctctgagcaatttcaattagagggttacattttagtaatctgtacagcttcaactgatgcctgctcgtcgtgacgggagccttttagatttccttcagaagcttcaaggatacaaaactaattggagttttgacgctgttttacatctcggtaattttattttcggggcttagtgttactttgctgtcaaattaaatcagcctctgtattgtgcacgtcagaactgcacagagaaaattccccagtattccaagccggtgcgcccctgtgcagaagaaaacagatctacgtcagccagcccggggggcaaagcctcagttccactgccttcctctccctctccttccacgggagaggagaaacttaaagaggtttacattgctgcatttcaataaaattttatacttgcttttggtatgattttgtacaatttgaaatttgtagctgagctcttttggtgtaactttgatgtaatgatgttcatatgacatcttgtacttcagagacacagcagcaatgcagagcatctcacacatgtgaatacacttcagtcagtctgtgcctgtgactaagtatggtcaaatttcaagtatcttcatgtgaattttccaattttggtgtttttcatagaaaacttcaatgccagaccagcttccctggttacttagcatatatttgtgaccatttcatatgcactcataaatatccaaggatttcaggcccagccaagaaaaacataagaagggaggtaaaaaggatgttggacattgacttagtgtactttttaaacccaacaaaagcgatgtggtgattatctcccttttcgaaggattcatgccactgtaatgagagaggcagtgtaggcaaatggtctgagccttggatggagattgaagtcctgactttagctgggaaatcttggttaagagtctttctgtaccttagtttccctaagtgagaataagagagttggacaagacgaatgtatctccaggttccaatttttctgagaatggttgatagagaagctgctctctccttaaaatgcatggactcaatggcttgaagatattccccatggggaaccattgccacggaggccttgcatgcaagaagtttgggtggggacagtgaggaactgaaacacaagcaccttccaccaattattgctgtgaagaacctgagcctgaagaagctccatctaattttttccccagagttccagattttagggtgcaatcatccagcctatacatgtggctcatagttcaaaaaattaaaagcaaaaccagaactctccagtaggaatggagaaaacctatctgtaggctgaactggctcctttgtcttaggaggcactggtcaggggaaaaaagctgtcttccagacccctcctttctgggtggctactgtggaatcaacggggtcactggctgtaaatcagtaagtcatagctccaaacagcaccaacttcaggatgatggtggaagctctgtccctataggagccaccgttgccagctgtcacatcccaacctaggtcaaatatggcggaatattgatttcgtctctaactccctgtatctcttacaaaggtaaagcaggtagcgaagccaccttgcttccctggtctttgcctagtggctggcaatgtttacaagtgtaccttactttatatcaacatgaatttgtgaaaaagctgtatgtcaatggattttttaaaaattaaaaatgtattttgaatgaccctaagggagctggctctttaaaagcatcctaaggtaaagattttttttaaatgaagaatctttttataaagcaatgaacaatctctgattttataaatcttaattttcctatgggttttcttaaagtgaaatacaattataagaatacattttaagggtaacattaacaacctagaacccagtttgggttactaaaaataaaatgtcagtattatcaattgataactaccacagttttatactctgcaagtgtgtactgcatgatggttaaggaaaaacaaatttattttagaacaaagcaaaccagagtttaaagatcagggatttccttctttccccagtgctaattttcccagtgttaattttattatatctttaggtaagggtcttaaccaactgatgcctcagtttcttccacagagaatagttagagggatgctgtcatgaactaagggaagggcactgaatttttttttgccaatatcaaaagtgacatttccccatgatgttcaagactcaccaggtttctctctccacctgtacctacacccagctagatcttgtcgttaaagatgtatggagggaagaggtttcaatccttccctccttggcaacctacattgttaagtgactcaaagtcatgtgatttttggtggacaactggaatcctccttcttgtaaaacacattgaaaaacagctcatctctcctgttaggcttaacccttgagatttgagacaaagctaataatcccctttggttcacatctcacagtaaccaggagaacctatggttcatttgccaagtgattaaaaaaaaagatggaggagggtgtctctgaattttaatggaaacactgccaatagcatggtgggtaacctagggcaagacagactttttcttcctgaaatcactcttctaaagctgagaccggaagaggaaccttgcagaagtgcactgtgaccacagttcttggcatgaaagataaacaatttgcagtctcatgccaaaaagtatttccttgcatttacattcattacttagaatgatcacattattcatttttttccccagcacagaaatttgcattttgcacagaatttgcctggtgcagcagatctttatagttatggaaactgtcatcattatcggaatgtgctgctgctcaactccccagacataatttaatatggtgaggagaatatgacctgcctggctctatgggtgatcatatttctactgctgcagcaagctgggcttgtgtatttttcctcacttcagttgttcttcccatagttcatgtagggaggcactttggcttttgaaacactacatttctcaatatttaagcacaatttattgtccttatttttcagaacccattaaatataagggtcagaacctagaaaatcttatgtgctggatttctaccctgtatgattcttttcatccatgctttgcacttacgtaggaatatacataatttggtctgaagaagtataggaacagttgagcacattacttcaccactggaagaataggaaccagggaaaaacatcagcctctgccacttggagcactagaggatgacggaatgtcttgtatatgcggtcaactgttcaggatttactactcaattggttgttcacaatcagggaaatgattggcttcttggttgtttgttgaactttctttctttatatggttaaattattttgttttgataaaaataaaacttaaaatgc

SEQ ID NO: 23465 - DNA, 5380 bp, Homo sapiens
  ENST00000319555
cgccgctcgccgcccgcgggttccattgagaaaagccgagcggccgcggcggcggcggcgagtgcgcgggagcggaggagccggcacccgcccgtcgggcagtccgcgcgcccgcaacgcaggaccgtggcctctcgggcctccgcggcagctccagcggctccggggctgggcgcgcgggctgggggcgcgggccggggcggccgcggagaccgggggccgggggcatgagcggccccgcggccccgccgcgcccccgccgcccgccgccgcccgcccggggctagaggcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgagcccagccctgaccctgctgctggtggacgaggcctgctggctgaggacgctgccccaggccctgactgaggccgaggccaacacagagatccacaggaaggatgacgcactctggtgcagggtcaccaagccggtgcctgcggggggactcctgagcgtgctcctcacggccgagccccacagcacccccggccaccctgtgaagaaggagccagcagagcccacgtgcccggcccctgcacacgacctccagctcctgccccagcaggccgggatggcctccatccttgccaccgcagtgatcaacaaagacgtcttcccctgcaaggactgtggcatctggtaccgcagcgagcgcaacctgcaggcgcacctgctctactactgcgccagccgccagggcaccggctccccggccgcagccgccacagacgagaagcccaaagagacctaccccaacgagcgcgtctgccccttcccccagtgccgcaagagctgccccagcgccagctccctggagatccacatgcgcagccacagcggagagcggcccttcgtgtgcctgatctgcctgtcggccttcaccaccaaggccaactgcgagcggcacctcaaggtgcacacggacacgctgagcggtgtctgccacagctgtggcttcatctccaccacaagggacatcctctacagccacttggtcaccaaccacatggtctgccagcctggctccaagggtgagatctactcgccaggggccggacacccagcaaccaagctgcccccagacagtctgggcagcttccagcagcagcacacggccctgcaaggccccctggcctccgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccgcctggacccttggcacttaataaagaagttcagtttgatgagcatggtggtgggccagcctagttctctgagccagcaggcacacgcagccagtgtcacatccagccctgctgtgtacacaggccactgcggcccggagtggctgggcccctgccggagttacaccactgggtgctaagagctagaccgagcgtcaggtcggaggccacagcacacactgaaccactgcagggccagccgctctgggcctaccccaccccagccctgtccatacccccctagggagagcagcctccacactgctgaccctctccacggtctacttggccgccagacacggaagagaggggcactgacctggctggccatcccccaaccctgcatggtcctgggggtccgatgtcccccatccagtcacagaccaccagggatggcaggggtgggggcgccctggggaggatgaagccctgtggtggccaaggctgggggaagaacaggcgagtaggtggacaggagagggagaccgaggccgaagcattccctggcctcgagggggtcctgatgctcactggtgggtgcatctctccctcagagccagggctgaggacaaccgtgtggtggagtcacctgtggtggctgagtcggtgcaagggtcagggcacccccaccccccgtcttccctgccctgctgggctgtatgggccggccacactgagggagtacttggctgaccgcgttcagccacggtgtcaccgtgccgtttgcagctgggtggctgtgggcagcctccagcgtgctttctcactggagaacaaaaacactcttctattcccaacgtcactttatttttttatttttgggtctcactctcttgcccaggctggagtccctgggatactcacggctcattgcagccttgacctcgtgagctcaagtgatcttcccacctcagtttcctcagtagctggggctacaggtgtacaccaccatgcccagctagtttttgtgttttttgtagaaatggtgtctccctatgttgcccaggctgggcaaccctatattttttagagctaaggtcttgttcggttccccaggctgaagttcagtggcacgatcataagtcactgcagcctcaaactcctgagctgaaaccatcttcctgcctcagcctcccaagtagctgggactacaggcttgacccaccacacctggctaacttttaaaacatttttatagagacagggtcttcctgtgttgcccaagatggtctcaaactcctgacctccagtgctcctgcagcctcagcctcccagaacattaggatgacaggcgcgagctaccattcccagcccatttccaactctacttgaactagctgcatttttttcagctttgcccagcagccctggtgagtgcaggcaaagaaggcagcggcctcttgcctcagaagcccgaggcacttcccagccagtccagggctcgctctcctgcccgcagctcgtgggcctgggtctgcagcgctttcagtggtctctgatgtctttgtccacctgcccactagggtctggccagatggggcccgtagccaaggccaatggacagacatggcttccaccccctcccagggacctgagctccagggaaggcaagcagccttttcctcacagacaccccttctgttgaagaccaggtgatagcggggacgggaggcacggacccctcaagtctgctcatcatttgcattgttgtgcatgaatttgcgtggagggttcaggaggctctgcccccaagtcctccccaggtgcgggcgcagggtacaagatgttctaaaaaatagaaacctggtggggggttgtcactgtgtgtacatttaaaagtaaactgtttaaaggtg

SEQ ID NO: 23466 - DNA, 497 bp, Homo sapiens
  ENST00000562417
gcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccaggtaaccacgcgggtggtgggggcagcagcatcgcctcccgggcagcctggcccggcccctgggagcagggcgacgtgggtgctggggcaggtgtgcaggttgctggagacccaccaggcccaggcctgtgcctagtccaaagctcagccaacccgtgcagctggtggtatcactggagcttggcaccctcgcgcca

SEQ ID NO: 23467 - DNA, 563 bp, Homo sapiens
  ENST00000569086
gcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgatgagaaaactgaggctccaagatgttaagtcaattgcccaaatacccaggatcaaacagcagagggagaaatagaacccacatctgcctatccccggagaccctcgcaagctccttaatgaattaaatccttgattaacccttatc

SEQ ID NO: 23468 - DNA, 808 bp, Homo sapiens
  ENST00000563351
ggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagacgagctggagccggtggtgcaggatgggcagaggcgcatacgggcccgactcagcctcgccacgggcctgtcctggggcccgttccatgggagtgtccagaccagagcctcatcccccaggcaggcggagccgatgagaaaactgaggctccaagatgttaagtcaattgcccaaatacccaggatcaaacagcagagggagaaatagaacccacatctgcctatccccggagaccctcgcaagctccttaatggtagggctgaggggctggcaccggcccaggagtcatccccacgggctgccctttgccctagctgcagtcacccctccctgtccgcctgcctccgcatttagtcctgctctggcctagggcacaggccatcctggggatacgggcacggggttagaaacgctcccaagtggggagataacgtctgggggcacaaggggagccaaggccagaggagccgctggggctctgtggggagcccggggaggaaggagcccccgctccactcttccctcctctgctttatctcctgcagaattaaatccttgattaacccttatctccccagcgaggcgctatctccgccttggcgccgagtgtccagacacaccgtacaagatgattgatttcttcaagata

SEQ ID NO: 23469 - DNA, 502 bp, Homo sapiens
  ENST00000562437
ggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgcgaggcgctatctccgccttggcgccgagtgtccagacacaccgtacaagatgattgatttcttcaagatatgcacgcctttccgata

SEQ ID NO: 23470 - DNA, 720 bp, Homo sapiens
  ENST00000521923
actggacccaggaagttcagctggcctcacctctcaattcatcaagaaagacatctgagatgtatgaatatcctgtaagactgacccaaatcctgctggcttggtgagctcatctcccagttgcctgattatcttagaacattgaagagctccagtgaagatgaagacagggacttgctatggtacccaggctggacttgaactctggggctcaagcattcctcccacctcagcctcccaagtagctgggcctacaagtcttcttggcttcaagtcttcttcctcagcggtctcactctgtcaccaaggctggagtgcagtggtgctgcgatctcggctcactgcaacttccacctccaaggcccaagcgatcctcccaccacagcctcctgagtggctgggactagaggaaacattcaaatcagttgacaaagaatggctgatgctgaaatgacttgctgtctcggtgtggagtggaaacaatcctgctaaatttcatattgcagtgacaccaaagcaaaggacagatctcaagacaacttttattgaaatggaaaacagttaattttaactaaagaataagagaaatgccaacagaaataaaagacccagaaatcagaggacaatgtgcgaaactctatatactgagacacacaaattgaaacaacccaaataaatgccaaatgcacaagaaaataaatgtaacttatcagaggttaa

SEQ ID NO: 23471 - DNA, 596 bp, Homo sapiens
  ENST00000518180
gtgcttctttcctctctctgcctccttcacatctcccttcaaagatgagactgggaaaagcgggtgattcatcaagaaagacatctgagatgtatgaatatcctgtaagactgacccaaatcctgctggcttggtgagctcatctcccagttgcctgattatcttagaacattgaagagctccagtgaagatgaagatatgtttgtttattcgaacaggatgcagtccagtcttgctgacttctttggactctgatcttatataccagtggaagaacactgtacacaacccaatgcagaaagaccactaaagacttaacgccctctggaaagaggatttcgtcaccctacaaagcaaagagccattatcaactagagtatcatctaaaggcaatgggaacatggaatgcagtggaggaaggatgttaaggctaccaactaagttctcaccttcagctacaagaatgagaactataaaagggccgcttgaagatgccattgaagatgaggaagaagaatgtccatcagaggaaacagacatcatctccaaaggagactttccattggaggaaagcttttccacagaatttgggcctg

SEQ ID NO: 23472 - DNA, 4700 bp, Homo sapiens
  ENST00000407775
ctctccccctcccctcctcactgtcacactctctgtgcccccgtctctcttctctcatttgcttgctcatctccgaacgtgaatccgcggctcccggaggagcccagcgcccggagcacctggagtccggccggcggcgggccgagcctggccagcggcggcggcggcggcggcggcggcgggagccgagggagcggcagccgcgaccgcgggcaccgcgggagccccagcggcagcagccgccgccgagatgtcccggcgaaagcaaagcaaaccccggcagatcaaacggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaaagaaaatagtcacaatacagaaaagcattttagaaatagcttcaaaagcacttgtgtatcttgattttttcttatatgctgttgcagatatatgtatatgctaaaatataacttgcaaagatgttctaaatacacatgctataagttcgccttaagatttcaattcttggataatcaggctctgtttgcactttatattttagcagatacagtctcttagtcactaggctttgcatttgtatgtagctgtatgtttccgtccattttcttaatcctgaacctgtatgttaaatgaagatggcaatttttttcttgtatagtacttgtattttctttcgctgatgcagctctgtctcaatttttaaacctttgctgttaaatgcaatactttataaagaatgaacaaaattactggaagcagtattgtaagtaatgaggtagtattaatcagttttatcttttgaaaggcacagtctaaatcgaaaccctaaactcaatgctgcaagtatgaatttaattcatatataagatctatttaaatataagagtagcaatactgcacctggtgatcacaaagataatgttctacttctgatagaaataatttctcaacaaatgttgttactatgcatgtatatggatggaataaaattccagattgt

SEQ ID NO: 23473 - DNA, 3960 bp, Homo sapiens
  ENST00000520492
gtaaaagttcgcgcctctgcggcgggcggccgtgcgtctctgccctgcgggcgcgggctggtggctggcaggtcgtgtcctgggacttcgggcgggtccggctcacgccgccaggacgctcagccgagcggggattcgggtggtgtctggccctggtggcgcgcggagtcctccctgggaggggccgccagtcacttcccagcgcggaagctggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaa

SEQ ID NO: 23474 - DNA, 594 bp, Homo sapiens
  ENST00000520027
agtgctaatcaaagtgtggtcagtgcacggaccaaagctatcaacatgacttcgaagctggttagcaaagcagaatggtgggatttgcctcagacccactgacacagaatctctgtgtgtggatcctaggatgctgtggagtaagtaacaggttccccagggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctg

SEQ ID NO: 23475 - DNA, 574 bp, Homo sapiens
  ENST00000524235
atcaacatgacttcgaagctggttagcaaagcagaatggtgggatttgcctcagacccactgacacagaatctctgtgtgtggatcctaggatgctgtggagtaagtaacaggttccccagatcattgaaacaaccaccaaatgaaaaatcatccgatatacccaccttaggcccagattgcacagcgcagctgttggtactgactagatgaaaagcttcactgtacattgggctgtccatcagcatcgtcagggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttc

SEQ ID NO: 23476 - DNA, 1582 bp, Homo sapiens
  ENST00000511341
ctgactggtgtgtttacaaaccttgagcaagatacagagtgccaattgctgtatttacaatcccttagctagacataaaggttctccaagtccccaccagactcaggagcccagctggcttcacccagtggatcccgcattggggcgcaggtggagctgcctgccagtctcgtgctgtgcgcccgcactcctcagcccttgggtggtcgatgggactgggcgccgtagagcaggcggcagcgctcgtcggggaggctccggctgcgcaggagcccacagcgtgggggaggctcaggcatggtgggctgcaggtcccaagccctgccccgccgggaggcagctaaggcccggcgagaagtccggcacagcagctgctggcccaggtgctaagcccctcactgcctagggcgggcggggccggctggctggccgctctgagtgcagggcccgtggagcccacgcccacccggaactggcactgacccgcaagcgctgtgcgcagccgcggttcctgcccgcgcctctacttccacacctccccgcaagctgagggagccggctccggcctcggccagcccaggaaggggctccaccgtgcagcggcgggctgaagggctcctcaagtgccgccaaagtgggagcccaggcagaggaggactcgagaacgagcaagggctgcgagcgctgccagcacgctgtcacctctcaatcccactcaaactgtgtttacagagcatcagagaaaaaaagacaacctgtattcgccctggaaaaactaatggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaatagtaagtgctcagtgctgtgtagcccagctttagaggtgatgggaatttatgggagaaaaaaatgtctactgacaagaaaccaggaacagacctttttccttca

SEQ ID NO: 23477 - DNA, 468 bp, Homo sapiens
  ENST00000522160
ggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccagacatgcaggagaatgccttgtggagataaaggcagagaccccagtgatacttctacatgccaaggaaagctaaagattgccagtaaaccaccagaagctagaggagagagacatggaaccgatacttcgtcatggccctcggagggaaccattgccgttgacaccttgatcttggacttttaacctccagaactgtgaaacaatgaa

SEQ ID NO: 23478 - DNA, 3300 bp, Homo sapiens
  ENST00000517361
agattcttagaagacccttcagagtctgaagtaaagaaagttttgaacctgttttttcattctactgtagggcttctgaaaacaaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtcc

SEQ ID NO: 23479 - DNA, 3312 bp, Homo sapiens
  ENST00000522296
gaaactatctagagagttaagctcaagttaatttcacatgcagaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaatgacacttcatatgacacaaaatcagtcgtctggagtcccaagatctgtgttctagccatatctgatttttatctagctctatgaaaacacatgagtagcagacacatcttaagaggagaatagattctgaagttagtagaaatatcagattccacatgtctaacgtgaacatgtgccactgtttgcctggcttagtcccattgtacatttttatctggcatccctctggatggtgactcctttcctctacgaaagtcctgagtttgcacaatacaagaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccaga

SEQ ID NO: 23480 - DNA, 475 bp, Homo sapiens
  ENST00000497813
aacacatttactgcgggcgggggtctgagggcctgcaaacaactcgagctggagcctcggccaggaccggcgcgagaggcgccggagcccggcccagtgctccagagaaaggccggcctgcagcacccgccaccgtcgccggccgcccgcacgtccgtccgccccgtgactggctgcagtttccgctgcgtttcagctgagctgccgcaggcggccaccgccgccgcccggacgccgggaccgtttcaccctcagcgcccctggccctgcgccttcccccgcgcctgtagccacccgagggcagtcggggcaggtggcattccggacacctgggcttaccagggcatacgggaccccaggaaatgttatttttgcttaagtcaaatcatatgtggctgctaaggtgctttcgatgcagttgtttttccaacaatctttgccgccccgagtatctgaataaaggaagaaaaataaa

SEQ ID NO: 23481 - DNA, 600 bp, Homo sapiens
  ENST00000428571
gacggcgggcccgtgccggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgg

SEQ ID NO: 23482 - DNA, 300 bp, Homo sapiens
  ENST00000419690
agtgctccagagaaaggccggcctgcagcacccgccaccgtcgccggccgcccgcacgtccgtccgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgt

SEQ ID NO: 23483 - DNA, 7558 bp, Homo sapiens
  ENST00000379177
gccggcctgcagcacccgccaccgtcgccggccgcccgcacgtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacagacagtcttcctctgtcatccaggctggaatgcagtgcagtggtgcaaatttggctcactgcagcctctgccttctgtgttcaagtgattcttcttctgcctcagcctctcgagtagctgggattacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagtta

SEQ ID NO: 23484 - DNA, 2996 bp, Homo sapiens
  ENST00000304543
gtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtact

SEQ ID NO: 23485 - DNA, 673 bp, Homo sapiens
  ENST00000459724
ggcctggtcggcggcccgcaaggcgccctcccgcgctaggccgggcggcgtggcgcgcggcgccgagcaggccccgaggaggccgcagttaggcccggggaggagcccggctgccccgagcggcggcggaggcgcgctccgtaagcgggcgggggttgggggagggtcgcccggttgtgccggaggcggtcgaggggccccgggtcggctccgcggccgacctggggcaccgcgccggggtgaggcctggcgaggaggcgaaggctgcaggcgtgagtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaagtaataattctgatggaattgaaaaccggaatggcactgcaagtgccctcttgcacatagatgagtctgctggcctcggcagactggctaaacaaaaaccaa

SEQ ID NO: 23486 - DNA, 367 bp, Homo sapiens
  ENST00000480195
ggtagaggtggaggtggagaaaggacgtttcaagggtgaagcttcttcagtaaacactgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggtataactacttgaattgttccacttcccatctaccagatttggagttggttgtcatcaatgaattgctagaactctcacattgatcattcacaggttatcttgttatcctgtc

SEQ ID NO: 23487 - DNA, 2906 bp, Homo sapiens
  ENST00000338565
gagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttcctgtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaa

SEQ ID NO: 23488 - DNA, 651 bp, Homo sapiens
  ENST00000474385
ggcttgaattacaacaagagccaaactcattttttgatgcaacagtttttcagaacacttcccatacattcccatttgatcatcaccacagtcctgtgagattcagaggatgatttctaaatttctatagccatagatggagcatattggtggtatattgcaccagaacaaaaagggaagcgtgtgaagggagaaaggaaaaaaaatagaagtaaaagaaacacatgggagagatggaaagaagaacaaatatgagttgaggagagggaggtggagcaaaaaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtct

SEQ ID NO: 23489 - DNA, 7513 bp, Homo sapiens
  ENST00000379188
ggcccagtgctccagagaaaggccggcctgcagcacccgccaccgtcgccggccgcccgcacgtccgtccggagctgtgactgatgagaattaaaggccatggatgaagatgggcttgaattacaacaagagccaaactcattttttgatgcaacagacagggtctcgttctgtcacccaggctggagcacagtggcgccatctgggtccactgcaacctccgcctcccaggctcaagtgatctgctcagcttcccgagtaactggggctacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 23490 - DNA, 6801 bp, Homo sapiens
  ENST00000539115
cggggagctgggccgctttttgtcagctccgagctcggcccctcctccctccctccgcccgccccaccagccggagcccggcccagtgctccagagaaaggccggcctgcagcacccgccaccgtcgccggccgcccgcacgtccgtccgtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttggaattcattttttcttttatcttcataaaggatttgttttattagcatctccaattcccctgagataaattactcatgcataaagtggtttttgagagcacttaaagttcatttcagtattaatttacagcatatttaatcagtggggactgttaccacctccacaacagaaatcatgccctcgagttaccccactgcgcccagtttagaggactagtagatgctaacatactagggaatggtcattgccacagttaaaaatcggcagttaagtaaatgtcaggagtcaaaagagatagagttgtgccatctttgattttatagacaagattctgcagttcttccaactgtatgaacaaacgtttgcctaatagttgaaacaataaattaaaattttaggtaaatgacgaagggaatgtggtgaatgtcactgtccagagccataaatcagacaaaaccatacatagcatgctgaaaaacttttgtaatggaacacccaacaaatgacacctaacctgtctgtgatccaacaagtccgataacatgctgctgtatttgtattctctgggaatctcagtattaataatttcatttcccacaaattctagcattcatgtaaggaaaaacatggctaatcaatatcttaaaggggcaatctttcagagcagtggttttcaaagtatggccggacagcattggcagcatcttaatctcctgggactttgttaaaaatgcaaattctcagccccaccctagtcctactgaattgggaaactggcgtgggacccagcagtctttgttttaacatgttctccaagtgattctgatgcctgttcaaacttgggaaacacttttagagcacttgaggaacctaaaagatgactggttcagcattttgtgtggtagataagaaagaaattatcacaaaaaatcagaaatgaacagtgagagaaaaataggaccccagacagtttataccttccatttgctgttttaaaagtgtgagcctgccaagtcaacaagtatgcctttagcgcacatgtaaatagcctgcacttcctaaatctcgtgtggcctcccatggttacattcttcaaaggtaaactgagttgagaggaagattcagcatttaaaagagaagggttgaaaaagattgtgtgtgtgtgtgtgtgtgtttaattggcccagggttacttaaataaatcataaccattttgccacattctgtaactgtttagctaaggtcaaattaagtttaccctatggattttgtttcatcttttgtttcgtgtatatactgtttgcctttttcataaaaatcttggatttgttatatattgttcctgttatttttgacatctttgctattgtaaataaattactattttgttttaagttaccctagtggagtgttggctatagacaaggtatatactcgaaacgaggagacttaaatcacacagttaatgaattcccaacttgtttgaagctggaggtgattcgactcccttcagtggttcaacactaataatagcaccaaggaacatgtcactggtgcatatagg

SEQ ID NO: 23491 - DNA, 5113 bp, Homo sapiens
  ENST00000383052
gacggcgggcccgtgccggggagctgggccgctttttgtcagctccgaactcggcccctcctccctccctccgcccgccctaccagccggagcccggcccagtgctccagagaaaggccgtcctgcagcacccgccgctgtcgccgaccgcccgcacatccgtcgggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatga

SEQ ID NO: 23492 - DNA, 2273 bp, Homo sapiens
  ENST00000625061
agagaaaggccgtcctgcagcacccgccgctgtcgccgaccgcccgcacatccgtcgggagctgtgactaatgagaattaaaggccatggatgaagatgaatttgaattgcagccacaagagccaaactcattttttgatggaatagtggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacattttt

SEQ ID NO: 23493 - DNA, 678 bp, Homo sapiens
  ENST00000469869
gtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgagtggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaagtaataattctgatggaattgaaaaccggaatggcactgcaagtgccctcttgcacatagatgagtctgctggccttggcagactggctaaacagaaaccaaagaaaaagagaa

SEQ ID NO: 23494 - DNA, 567 bp, Homo sapiens
  ENST00000443793
tggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaa

SEQ ID NO: 23495 - DNA, 3464 bp, Homo sapiens
  ENST00000449237
gggcagggtgggaaaagttcgcccgtttgtccggaaggcagttgatggacctggggtcgacaccactgcggacgcagggcacggcacgggggcgagaaggcgaaggctgcaggcgtgaggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaagtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgc

SEQ ID NO: 23496 - DNA, 803 bp, Homo sapiens
  ENST00000478783
aaataaagtaaggactttctgtcattcatgagtgtcaggacttcttgttgttaataaagaattcgtaattctttagaatttataatgttgtgtaattctgtgttttaatgcacattgttaggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaa

SEQ ID NO: 23497 - DNA, 5239 bp, Homo sapiens
  ENST00000155093
gcctagtgcgcgcgcagtaacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatg

SEQ ID NO: 23498 - DNA, 567 bp, Homo sapiens
  ENST00000472523
agctccctgcactgcgccctgggtgggtgggtgaatgtgaagaggcggcgttgggctaggcccctgcagcccgctcggagcgtcctaggcccggggctgcgctgtgaaagacccagattctcatcccagaggcccagcagtcctgaaaggcctcctctccgaccctgagccgggtccgccgaacaaagttcggaagctcgggctagctgggccagcgccattttctcgcacttgtggctggatctggttgtcccggcgactgcgccccggcgcggtctcttttcctctacctcggatccccagcactgactcgccctcagacgccggggaaggtgtggtgagctcccggccccggccgaggggtccctggagaggagctgggtggcggtggccaggccgagcgcggttgctggcccgcgcctccctccccgaggcaccattgttccgggatcgctgtgaccgccacaaagtgaatcctttcggtgcggacagtcgccttcaaagccaggccccggattcagctcctgggaagctctaggatgtgactttaagctggaaagactctca

SEQ ID NO: 23499 - DNA, 539 bp, Homo sapiens
  ENST00000488404
atcctttcggtgcggacagtcgccttcaaagccaggccccggattcaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatccttttttaaaaaa

SEQ ID NO: 23500 - DNA, 5241 bp, Homo sapiens
  ENST00000282928
atgattgctgctatcagtctcgcgctcaccgcccggctgaggaggtgaaagtttctccccaggaagataaaccgcaaaagacaatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggagaagtaaggaggggcgcgctgcgcgaggcggagagagggcgaagcagtcgcggcactggcgctcacattcctctatgctacaaatccaggaggaagtttttttttagggggctgagatgctccatgcctttccccgggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacggccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatccttttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctccgtgattgtggtaggaatttcttcttcacccaccagcaacctgctgcctcttctgccagtcttaaagggtctccagaaaagctctccagtctcccttgccttccctttctgtcactgcaggtcgtataaacgtgataaatgaatgctaccctgctggctctccgagagagtgtaattagtatttatatcaaaatttatgaaacaaattttcggccgcagtataatttaaatgacctttgcagatgtagaataacaaccataaaaataacaggaatagattgcacaggcgacatcaatattaatgtagacgaattgtcagaagctcaggggctcgctctgcaacattgcaaatgaacttgcagccgagggttccgctgccccctagattaaattccccgggctgaaactgagttgcagatttacaatatcatattttaaattgctgtcttcaattaaaccatttatgaccataactaattttcaggatgtcgatgcatgcttttccaggccttccttctttgtacaaaagtaaatgtccataaagcgtttcacttatattcttcaaacatgatgctaatttaaattaattacttcctatgatatgttattattcctatgattttgccactgttattagttctctcaaaaatacatctagggaagaggattattttaagtaatttgattatctttctatctcttttatttatttctcatttacttaagaaattcgttccattggttggcattgatacagtaaatttgtaaatgaggagacaatataaaaaatctaaattacttgtgcttaatgactgtagcagaatgccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggctgtagttgctagtgtgtggaggtgcagagcaggtggcagaaactgacctcactgggcaagggtggccatggacctgattctttaatgcactctatgtgttcaggaagccacaggccatatttgactctgagaaagaaaacaagaggaaaaaccccacaaagtataacaaccccttaagatacatctattttaaagtgaaattaatttttcagtttataccattggccaattacaagataaaaatgttcaatttctttaagaatcctttgttgacttgtcttttcatctcttgctatttatatttgtcactgtttcaacaaagtcttatttgctgaggaaggactttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaattggtttggaagtttgaaactgattaacagatttgcatttgaagtgactccagacattaggtccagacattagttaaaaatagaaagaggaataaagacatctcttctctctagaaaagataacaccacaattaataatccttcccactttcattgagatcagcttgtctgataacctgatatgagtgtgataatgataaacatgataatagtggtacttttgtaattttgctggtgcatttaagaagatagtaaatgatgagttcatcttttcttcgaacattcctattcctagatgtagtttacctcaaattgggaattataactgtctaatttttgttgtgtacctgatgccccttttgctttaataccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagccaa

SEQ ID NO: 23501 - DNA, 1044 bp, Homo sapiens
  ENST00000474034
gcggcgaggagggctctgagtcctctcccggccaggccgagcttagtatgtggaggcggcggcgggagtgcgggcatggaccaagggaagggggacacccaaaccgcattggtgccttcctttccctccactcgcgccgtagacctccccaaattgcccgtctccggtatgactgaatctgtctgctggcctctcagctaccaactctgcccgaaatctagatcccagacctgctcctgggaagctctaggatgtgactttaagctggaaagactctcaggagctaggtttgatatggcacaatctcaaggcatcgctaagtctgaagttcttccagcaggtctgtaaaccacaaaggacaagcagctcagagattagcgaatgcgtctcagctgtcctagaaaagtgctgtcagcaagtctgaagagtttcccagaagccctgaaaggacgcaatagcatcatttagcagaaagaaacagccctggattaatgttcttttgggattcatcttctggctttgtgattttgggcaagttacttatcttcctccatttattcacatatataatgagaggagtagtacctaccttacaaacttttctgtgagaagcaaaaaaaataaaaataaaaaataaaaaataaaattgttaaatatttgctatgtgtaaaatgcttattcctttaaagttttcatgtcagttaaaacatgttattggcttgaatcctgactcaagaacggaaatagtaattgtgtctgccattcagggtgacacagttatttccactggttcagggtggtggggtgggagctactagatagaacaggtggggcaattcttgatacattttcgtgttttttgttactactaatccaccaactcttgttttcactcagaagcagataaaatggacatatttattatagactgaaaaatgataaatgagattaattttaaaaataaaatgaaaaggagaataattgtttataaatgtatgatttataagttctgaatgtataatttataagttctgcatgtatgca

SEQ ID NO: 23502 - DNA, 418 bp, Homo sapiens
  ENST00000481840
ctcctgggaagctctaggatgtgactttaagctggaaagactctcaggagctaggtttgatatggcacaatctcaaggcatcgctaagtctgaagttcttccagcagtaaaccacaaaggacaagcagctcagagattagcgaatgcgtctcagctgtcctagaaaagtgctgtcagcaagtctgaagagtttcccagaagccctgaaaggacgcaatagcatcatttagcagaaagaaacagccctggattaatgttcttttgggattcatcttctggctttgtgattttgggcaagttacttatcttcctccatttattcacatatataatgagaggagtagtacctaccttacaaacttttctgtgagaagcaaaaaaaataaaaataaaaaataaaaaataaaattgttaaata

SEQ ID NO: 23503 - DNA, 2983 bp, Homo sapiens
  ENST00000376335
ccgcctggctttggactcttctcctcctccacctcctcctcctcctcccgcgccgccgcctcctcctcctcttcctctccgcgccttcgctacgcgcccggccgcccgaggcagatccaggcggcggcggaggcggcgggcgcaggagagcggctcccagggctgaagtggccgccaccaccgccgcctgcgcctggagcccggtggccgccggacgcaccgcgcggatcgggagcgggagtcgaggcggcgcggaggcgcagggctcgcaggggcgggcgggcgcgctggccatgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcatgaacata

SEQ ID NO: 23504 - DNA, 455 bp, Homo sapiens
  ENST00000490085
tgaaaggctttgctgactcccccaaccctcgcccaccagcttgtgcctctccgcagtcactagatgctgccttatctctaatatttaccttttcttcaacttatttttttaaagacgggaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgc

SEQ ID NO: 23505 - DNA, 383 bp, Homo sapiens
  ENST00000468291
ccccacattcctgagaaatttgaggagatggacgtcagcctggaagaaagggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgc

SEQ ID NO: 23506 - DNA, 473 bp, Homo sapiens
  ENST00000477213
tgatcttagttctgccgcagaggggatcggactggtttgagggacccagccccctcaggtccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggc

SEQ ID NO: 23507 - DNA, 218 bp, Homo sapiens
  ENST00000481565
gtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggcatgaagagcaaaaatatcccttccggagtctttgaag

SEQ ID NO: 23508 - DNA, 3469 bp, Homo sapiens
  ENST00000287538
ttactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgc

SEQ ID NO: 23509 - DNA, 1968 bp, Homo sapiens
  ENST00000370606
gcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaagtgttgtcctgcttggtatccgggacagtctctaattcctgacgaagaacttgatactgacgttggtatgcagcagccagccctccataacactacctatcctaaatgcagggttaatgccgaacctactgtgcaagaaatgatttactgatgaggtttcaaagaaaaccacatcaatttggatgtctgttaccttgaagtgatcattttaagagtagtagcttcttccctaggtataaaaagactattttcttcttttggtgtatttcatcctgtgttgagcaatcatttgtgaaatgaaaaagcaaaaaaactccccccactttaggatttataaatgggaagatggaggtgaagactggcctaattcataacccagtatgcattatctcatgcattgtgttgaccttggtgaaaatctttttcaaataccagcattctatatgtagaactaaagtgtttaaaactagaaacatgaattgttgttttgttaattttatgtttgtgttcagaaagcaatacccaggatccctttaatttttgtttgacttaaataaaaccatttaaatta

SEQ ID NO: 23510 - DNA, 366 bp, Homo sapiens
  ENST00000478471
cgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggttcatgaatctcaagggtcagattcctcccctgctgccagttcaggctatgaatcttccactccacccgctatagcttctgcaaacagtaaagataccactaaa

SEQ ID NO: 23511 - DNA, 4331 bp, Homo sapiens
  ENST00000383075
acacaacaagggaggggacctaaggggggaagggtagctgttgggagggggagagggaaaataattcttcaaaaaagaaaagtcagtcttctcctctccagtccgtggaaaatccaacggggacgttgacaagagggtatttttaggaaacacatccaaatatacagggtaagagtgaatgtgagaaaaaaaaaagttgtgggttgtagaagttatcaagtgggatttgcggcgctctctgcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttgaa

SEQ ID NO: 23512 - DNA, 3550 bp, Homo sapiens
  ENST00000472749
aatattgtcactctaacgtgcactcgcgccttccctcggctctacagggcatcgcagccaccgatcccagcccctccccggcctatgccagccgcctggtggccctccgggctgcggagccaggcctggcctgacagcagcagctgttttcttcccgaagccgcagcgctcaagggcgtggttgcggtagacacctcggatcccatttggcctgtgcggaccctaccgcgccaacccctcgtcttaggaccgagaggcccgacagccaggtgggggtggtctgggcagaccggtcgacatcgcaagtcagtgcggactgggagggccagctgcccacagcacggtctccaggaagcctctggagcagcgtaatgaaatattattactggcgagcgtatctggagggatcccggaaggtttaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 23513 - DNA, 3317 bp, Homo sapiens
  ENST00000494569
atttattccgcatctttctatcactgttttataaaatggtgccagtgtcccgcgaaatggcaggtgccaacaccttccagactgttcagtgtactagctgtgctcctgtagggtgggaatccagcgaccaggtggtgccggagacccgggctcaggagccgctgattgcgcagaagcgcaggttgtgcgcaaacctctctgtccgagcctcaacagggctcgggaattggggctttgtttgttctaaccagccccaaagcgcctgtttttcctggatgcggcgggagaagcaactacaaaggcaacagttctccagctgcgcgtcttcctcctcagctagacgctaggtagccggtcccttaactcagagcgctgggaggcagccatttgtttaaagcgcccagaaaccttcttcccccatttccgcagcacttgcagctccggcaggaatctaggcttccgggttctcggggtcctttcctctcctacacgtcagcgaattcagctggccgtgagctccccgattggggctcggtccggccaatattgtcactctaacgtgcactcgcgccttccctcggctctacagggcatcgcagccaccgatcccagcccctccccggcctatgccagccgcctggtggccctccgggctgcggagccaggcctggcctgacagcagcagctgttttcttcccgaagccgcagcgctcaagggcgtggttgcggtagacacctcggatcccatttggcctgtgcggaccctaccgcgccaacccctcgtcttaggaccgagaggcccgacagccaggtgggggtggtctgggcagaccggtcgacatcgcaagtcagtgcggactgggagggccagctgcccacagcacggtctccaggaagcctctggagcagcgtaatgaaatattattactggcgagcgtatctggagggatcccggaaggtttaggcaagatttgaagaatgctgctaaatgtttgccctcagggggtagaaggaaagagggagggggctccattcctgtaaaaatctcttctgaagtgaatcattgctcagaatacctctccctgcagcacgaatccactttatgcacacacaatgtgcatcggctgcgcatccttaaattatttcatcgctttggcgtttgcgcaaaacctactttaggaaacaatttgggccaggatgggggtgggtgggggggatgaacggctgggcggggtagcggcagagaagttagtctgaaacagcaactttaaatcgagcagatgtgagcttccccgttaactatattgtgagctcctccgttaatgtatttccgagcagaggtgcttctggttccaagtggagaaaatttggaggaaacaacccgagtggatcaggattttcgaggatggaaactcgactaagatggagtcactgtcgctcctcctccataccctccccatgagcccagaggaggaaggcgggagggatggaggcgttcaagagagggcaccgggggcgctctctgcacgagggaaaggggtgctcgacctgaggcgccgtggaaagggatttctgaaaatattttgtagttcttttccagaaaatgagagacgaatgggggagggtggcaagcacctgacgggaacacgacccacaagcactaatgtctctgcgttgcctccgccaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtg

SEQ ID NO: 23514 - DNA, 2965 bp, Homo sapiens
  ENST00000493664
acttctgtagtgtgcaggatttcgcgtaggcattaatagccaagggggtgggcgcgcccaaatccaaaccttgggaagaagaagagaaagaaagaaagaaaaaaaaaactttacagaagtttttttgtgtggttttcctttcccctccccactgtcaggtggcagtggtgttagcggcccggtacagggagctccggggagcgtgggtcggcaagcagccggccgccctctcctagccaagcggggcactgaaaatatatatggctggggcgcttcagaaccaccaccacctccaacatcatcatttctgtcacctccactccccgcagggcatcgtgccccggagagccccggggtgttagccgccaaagtgcgcttggggctcagctcctacccctctggagcagaacccccagcaacccacagactcagccctgcgccttccattaccccttacatctactctgccgctaccatccctctctagctcatggcgcggcgggggacttggcccaacagcaattcggcccaatggcggcggaggtgtttggccttgctctgtccaccgggttcactgctggcgctgtctggctctgagttccacggctgactgcagaggccgtagtgcggcagggctgggcctgccccccggggcccagggaagagcgcgcagcccacgccacccgttctcatgcgcgctatttgtttcgacaacaggtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtg

SEQ ID NO: 23515 - DNA, 1774 bp, Homo sapiens
  ENST00000484399
gagaagtgatccagacctcttagaagttgggttggggctgccttatgggtggacagggatctctagggaacctcacacccatttcccccagaagcaaaagagtaaattctattattgccaaccaaccaggacttttccatgccagacatcctgccatgaggaaatttcagagcgaggacgcccagcatgccgcccttctgtaggaatgcaaagttaggcctcctttctttcctgatttgtgctggaaggagcttattacctttggggaagaatgccttttggttagaaagaattgaaaataataataccctctgggaaaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcaga

SEQ ID NO: 23516 - DNA, 1481 bp, Homo sapiens
  ENST00000473123
gaaagaaagctaggactggctcaaaggttggatctgaaagttggggttgatgaatggcccatgtcaaagtcttaggaaagcggaggggcttttggagggttgcacttcggccgtcaccgtcttcaggaaactccctttggattccaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaa

SEQ ID NO: 23517 - DNA, 834 bp, Homo sapiens
  ENST00000463850
agctggccgtgagctccccgattggggctcggtccggccaatattgtcactctaacgtgcactcgcgccttccctcggctctacagggcatcgcagccaccgatcccagcccctccccggcctatgccagccgcctggtggccctccgggctgcggagccaggcctggcctgacagcagcagctgttttcttcccgaagccgcagcgctcaagggcgtggttgcggtagacacctcggatcccatttggcctgtgcggaccctaccgcgccaacccctcgtcttaggaccgagaggcccgacagccaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaag

SEQ ID NO: 23518 - DNA, 534 bp, Homo sapiens
  ENST00000480015
ttcctggccctgccactgatgaattttcttctgctctatcctcttcagacgcaattagacaattagcactcctgcccgcagcccccacaactttcatcagatgaaataacatcctaactggagtggaactattttcatgactccaaataaaaaatgcagtcttccaaatacacctttagtgaatccgtccttgagaaagggggactgaaattcctgcctacacctaatacaatagggcccagaggctgcctgacccagcgcgggcagtcggcaacaaacaactccttcccatagtgaaacaccaaccccaccactaaggtgcagagggcatttgcggaacttgctgcttctgccaatgtttaaaaagtcccccttcctgaaatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgca

SEQ ID NO: 23519 - DNA, 610 bp, Homo sapiens
  ENST00000464502
gtggcggtcacagcgatcccggaacaatggtgcctcggggagggaggcgcgggccagcaaccgcgctcggcctggccaccgccacccagctcctctccagggacccctcggccggggccgggagctcaccacaccttccccggcgtctgagggcgagtcagtgctggggatccgaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatc

SEQ ID NO: 23520 - DNA, 925 bp, Homo sapiens
  ENST00000491672
aaaaaagaaaagtcagtcttctcctctccagtccgtggaaaatccaacggggacgttgacaagagggtatttttaggaaacacatccaaatatacagggtaagagtgaatgtgagaaaaaaaaaagttgtgggttgtagaagttatcaagtgggatttgcggcgctctctgcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcag

SEQ ID NO: 23521 - DNA, 708 bp, Homo sapiens
  ENST00000475502
ccggccaatattgtcactctaacgtgcactcgcgccttccctcggctctacagggcatcgcagccaccgatcccagcccctccccggcctatgccagccgcctggtggccctccgggctgcggagccaggcctggcctgacagcagcagctgttttcttcccgaagccgcagcgctcaagggcgtggttgcggtagacacctcggatcccatttggcctgtgcggaccctaccgcgccaacccctcgtcttaggaccgagaggcccgacagccaggtgggggtggtctgggcagaccggtcgacatcgcaagtcagtgcggactgggagggccagctgcccacagcacggtctccaggaagcctctggagcagcgcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctc

SEQ ID NO: 23522 - DNA, 929 bp, Homo sapiens
  ENST00000462748
gcagaggatgagtccatcccttcttcccaggaggagggaaaaggggtacaaatggggctcccactggcacaggaaccaggagcagtttgttgcctgcctgccttcccttctctccttgtgaattgcctgggtgccccaccgtgggcacaagaatggaagtcgtggcccagagcttccctcgcgaaaaatgagcaaggcgggtgccgggagggggcctttacaggaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacag

SEQ ID NO: 23523 - DNA, 500 bp, Homo sapiens
  ENST00000484586
ccacttggatttggcctgtggttcaacaagttaaacaactgcttgttctgtgggcagacatccccattgacagaggacttgctgtgtttgtccagcctgagaccttttcaatgactgtttttctttctaggccaaattgagggtgggggccggatagatgcttctgtctggctgctcaactgcctcagccttgcctgacagatgcagaggtcctcaggatggctttaagtatttaaggcggccaatggcttggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagccctt

SEQ ID NO: 23524 - DNA, 565 bp, Homo sapiens
  ENST00000463250
gcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtgggggtcaaagcgccaagttagcccagatggcagcaagacgatggaacttctccgccccaacctgacggcagatgccgcctgagtccacctcagggcggctccttgccctccctcaccctggtcctgcctcaggaagctgactgctgggatctgctctctgcgcgcggccagcagtgggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctg

SEQ ID NO: 23525 - DNA, 845 bp, Homo sapiens
  ENST00000464144
agagggaaaataattcttcaaaaaagaaaagtcagtcttctcctctccagtccgtggaaaatccaacggggacgttgacaagagggtatttttaggaaacacatccaaatatacagggtaagagtgaatgtgagaaaaaaaaaagttgtgggttgtagaagttatcaagtgggatttgcggcgctctctgcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtgggggtcaaagcgccaagttagcccagatggcagcaagacgatggaacttctccgccccaacctgacggcagatgccgcctgagtccacctcagggcggctccttgccctccctcaccctggtcctgcctcaggaagctgactgctgggatctgctctctgcgcgcggccagcagtgggttcgggacttggctttctttatctccaatgcgaacaagagcagcaactagctctctggggagcaggccgcagctcctaggattctggcccctagcctagacccaggggcattggaaattaggggccaatgaggagggaatagagctgagctgtgaaagaaagctaggactggctcaaaggttggatctgaaagttggggttgatgaatggcccatgtcaaag

SEQ ID NO: 23526 - DNA, 3979 bp, Homo sapiens
  ENST00000425731
gaaagaaagctaggactggctcaaaggttggatctgaaagttggggttgatgaatggcccatgtcaaagtcttaggaaagcggaggggcttttggagggttgcacttcggccgtcaccgtcttcaggaaactccctttggattccaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 23527 - DNA, 4152 bp, Homo sapiens
  ENST00000525172
gagaagtgatccagacctcttagaagttgggttggggctgccttatgggtggacagggatctctagggaacctcacacccatttcccccagaagcaaaagagtaaattctattattgccaaccaaccaggacttttccatgccagacatcctgccatgaggaaatttcagagcgaggacgcccagcatgccgcccttctgtaggaatgcaaagttaggcctcctttctttcctgatttgtgctggaaggagcttattacctttggggaagaatgccttttggttagaaagaattgaaaataataataccctctgggaaaaggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 23528 - DNA, 4639 bp, Homo sapiens
  ENST00000267294
ggggcgaatccccgctgggtcgagggcctgaacgggagccaatcgagcagccgaggctactgccaatcacgcggctccctccaatcccacccgtgccatttccaaaatctcggtcccactgtgcagctcaaatgtggtgttcactctgccaatcgctggaggatagagtgggaacaggaataagcagagttaagaggccaggacaaaagaagttaaagagcgcccaatacatacatgtttttgaaggcgggcagagggaataaagtccccccagtgagggtctatgggcctgattgtgtagttctgatggagccccctttgagcaagaggaacccgccagcgctgagattagcggatttggcaacggctcaggtccagccgcttcagaatatgacaggcttcccggcgctggccggcccgcccgcccactcccaactccgggccgccgtcgcgcacctccgcctgcgggacctgggcgctgaccccggcgtggccaccactccgctcggacccgagcacatggcccaggcgagcacgctgggcctcagccctccctcccaggcgttcccggcacacccggaggctccggcagccgccgcccgtgctgcagccttggtcgcgcaccccggcgcgggcagctacccctgcggcgggggcagcagtggcgcgcagccctccgcgcccccgcccccagcccctcctcttcctcccaccccttcaccccctccccctcccccgcctcctcctcctcctgccctctcgggctacaccaccaccaacagtggcggcggcggcagcagcggcaaaggccacagcagggacttcgtcctccggagggacctttccgccacggcccccgcggcggccatgcacggggccccgctcggaggggagcagcggtccggcaccggctccccccagcacccggccccgcctccccactcggccggcatgttcatctccgccagcggcacctacgcgggcccggacggcagcggcggcccggcgctcttccccgcgctgcacgacacgccgggggccccaggcggccacccgcacccgctcaacggccagatgcgcctggggctggcggcggcagcggcagccgcggcggctgagctgtacggccgcgccgaaccgcccttcgcgccgcgctctggggacgcgcactacggggcggttgcggccgcagcggcggccgccctgcacggctacggagccgtgaacttaaacctgaacctggcggctgcggcggccgcagcagcggccgggcccgggccccacctgcagcaccacgcgccgcccccggcgccgccgccgccgccggcgcccgcgcagcacccgcaccagcaccacccccacctcccaggggcggctggggccttcctgcgctacatgcggcagccaatcaagcaggagctcatctgcaagtggatcgaccccgacgagctggccgggctgccgccgccgccgccgccgccgccgccgccgccgccaccgcccccggccggcggcgccaagccctgctccaaaactttcggcaccatgcacgagctggtgaatcacgtcacggtggagcacgtgggaggccccgagcagagcagccacgtctgcttctgggaggactgtccgcgcgagggcaagcccttcaaggccaaatacaagctcatcaaccacatccgcgtgcacaccggcgagaagccctttccctgccctttccccggctgcggcaaggtcttcgcgcgctccgagaacctcaagatccacaagcgtactcatacaggggaaaagcctttcaaatgtgaatttgatggctgtgacaggaagtttgccaatagcagtgatcggaagaaacattcccatgtccacaccagtgacaagccctactactgcaagattcgaggctgtgacaaatcctacactcacccaagctccctgaggaagcacatgaagattcactgcaagtccccgccaccttctccaggaccccttggttactcatcagtggggactccagtgggcgcccccttgtcccctgtgctggacccagccaggagtcactccagcactctgtcccctcaggtgaccaacctcaatgagtggtacgtttgccaggccagtggggcccccagccacctccacaccccttccagcaacggaaccacctctgagactgaagatgaggaaatttacgggaaccctgaagttgtgcggacgatacattagaatttattattaataataataagtgaaataataagtgggagtccttggaccacatcctaacctgagacaatgccgagcctgagacaaacccgtgactcagacttgccaccgggtctaattagccctatttattcagtatgaaaccctatggtgtttgtacatttaattaatttaattaagatatttgggcttttttttttttttttcttaaaaaacaaacaaaaaacaaccaagctggacttgtacattgcaggaggatggggctgggggcaaattgtaccaaggaaaatgaatggagagattagttaatggcgatacacactgccgatgcaatatatatatatatatatatatacatatatatatatattattttttttaaaagggggagaaaaagagcattaagtcagaacttaacacagcaccaaggccctctgcatttcccagagtgcctctcaaatgcctttgacaccataccatgggctgcttttgagcctccttgttggaccctaattctgccaaggcctcttgattgtaaaccacacacctgctgcattgccaacagatcctgttccgtacctgtgtccaaaaacatttgtaaaaaccctttgagtttaatatttgtaatttttaatttccactcttttattactgatcttagcttaatacaatatttttatacaggattatttcttcagtatcctactgtgtgattttaaaaaaagatgcagcaaccttaatatatctccatatcttgtgctactgtgattgttcaagcaaaagtggagagaagaaaagctgctgcaaaagacaactgtgaaactgtgatattttataaaatagaagaaattcaagtgctttctttttcctatatgtttttttttttttatctgaattctcagatactgcctcctaactgtgtccaaacttcttgtgtaataaagagattctgttttcgatcctaagttctttgggatgccaacattcacagtcaagtcttgaggaggtgtgatgatggcatcatgcctatttttttggaaagctgttgtttttaaaacaggccaacacctcttttatactgttgtatcagccttttaaaaagtctatttttcaatgcctgaaactgcattttaatgcattttcttccacctgagcactgagcacaccaaactggaatccatttgaaaatgacagtgtgtgaagtgtatgatttacattaaaagaggggagggagttgccatacatattaaaaatttttaaaaggtttatagttaccaccaaacactgatgaatgtgtgacctttgccagagctgtcaagctaggataaaaaaggtcaaggacctaggacaataactcttagtcgatttattttcggttggtacaacacatctcctgtgcaaaatgtagtccatcagaaacatcctacagatacactaaagagcactaatttatccttagagaccccgaagacaccccctccccagggtttgtagaaatttgttttgtgtgctgtgagtggttgatgtagtcttgtcattgttaataacttgtatgtgaacactattatttgtacagttgaattaatttattttcagacatcatcctttttttttttctttcctggaagagttcaaagcacaccaaagaattatattatacattttggtgaaagattgtcatttatgatccatggtttatttaaaaaaaaaaggaaagaaaatggaaaaatatatttttaagcttacttgaatgaacaacgtaatgtgaaaaccaagactcttcctgcatgtcttttttgcattgtgttgataagattatatatagtttatagatatattatattactagtacagtgcatggtgctgtcacttggaaagcctttcaatgttgtcttcagattgttgtgatgaatatgaaacatgcagaccctcctttataaagaaaaagaccttaaaacttgaatatgagataattttacattttaaaagtttatttgattttcatattattcactttcaaagccctttcaaatagaaaaggtatgaacttttggggggataatttatgtatcgtaaacttattagaacaaaatattcctgatgtataatgagttgttttatttatacaactttttcaatggtagtttgcactattctttattatgctacaggtttatttattatgaaacaaaggaatatgtattttatgtattttaccatgcataggttaactctttgccacagatttattggttcttgatacacctaaaataaaaaaaaatgtgtacctccaatagagagcaagcaagaatgattatgaagtaacaaatttaataaaggtattcttgttattattgcttatgttttacataatggcatatctctcatacaaatagaacaggttgctaatgga

SEQ ID NO: 23529 - DNA, 9418 bp, Homo sapiens
  ENST00000324306
acgcttccggcctttgtgactcattgtgtctgtgtcgaggcgtcgggagggcctaagtccgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaaaaaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggca

SEQ ID NO: 23530 - DNA, 1449 bp, Homo sapiens
  ENST00000482979
actcattgtgtctgtgtcgaggcgtcgggagggcctaagtccgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgaggtaagaagcaaggtttcatttaggggaagggaaatgattcaggacgagagtctttgtgctgctgagtgcctgtgatgaagaagcatgttagtcctgggcaacgtagcgagaccccatctctacaaaaaatagaaaaattagccaggtatagtggcgcacacctgtgattccagctacgcaggaggctgaggtgggaggattgcttgagcccaggaggttgaggctgcagtgagctgtaatcatgccactactccaacctgggcaacacagcaaggaccctgtctcaaaagctacttacagaaaagaattaggctcggcacggtagctcacacctgtaatcccagcactttgggaggctgaggcgggcagatcacttgaggtcaggagtttgagaccagcctggccaacatggtgaaaccttgtctctactaaaaatatgaaaattagccaggcatggtggcacattcctgtaatcccagctactcgggaggctgaggcaggagaatcacttgaacccaggaggtggaggttgcagtaagccgagatcgtaccactgtgctctagccttggtgacagagcgagactgtcttaaaaaaaaaaaaaaaaaaaaaagaattaattaaaaatttaaaaaaaaatgaaaaaaagctgca

SEQ ID NO: 23531 - DNA, 2011 bp, Homo sapiens
  ENST00000426572
actcattgtgtctgtgtcgaggcgtcgggagggcctaagtccgtgtgcggtgcccttcggccggcctgagccccagagtcagctcccctttctcgcccagcgcccccaggccgctcccggggctcacggagtctctctctgtcacccaggctggagtgcagtggcgcgttctcagctcactgcaccctccacctcccaggttcaagtgattctcctgcctcagcctcccgagtagctgagattacaggaatagtaaagaaacacatcataaaacctcccaggacataaaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggaggg

SEQ ID NO: 23532 - DNA, 573 bp, Homo sapiens
  ENST00000432317
attgtaaccacatcagcaaagcactgttagtatatatgctgaacaaatgtggagaaatcgctgttttacataggaaaccatggtgatttgccccagaatgtgtatccaggaatagtaaagaaacacatcataaaacctcccaggacataaaggtgagcacagaccctgtttggatcaagtcagttcctggagcctgaatgatgactgctgaatcacgggaagccacgggtctgtccccacaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagagg

SEQ ID NO: 23533 - DNA, 9192 bp, Homo sapiens
  ENST00000620510
ttatacttcaggaatagtaaagaaacacatcataaaacctcccaggacataaaggctgcacaggagaaggatggtatcgtaatagtgaaggtggaagaggaagatgaggaagaccacatgtgggggcaggattccaccctacaggacacgcctcctccagacccagagatattccgccaacgcttcaggcgcttctgttaccagaacacttttgggccccgagaggctctcagtcggctgaaggaactttgtcatcagtggctgcggccagaaataaacaccaaggaacagatcctggagcttctggtgctagagcagtttctttccatcctgcccaaggagctccaggtctggctgcaggaataccgccccgatagtggagaggaggccgtgacccttctagaagacttggagcttgatttatcaggacaacaggtcccaggtcaagttcatggacctgagatgctcgcaagggggatggtgcctctggatccagttcaggagtcctcgagctttgaccttcatcacgaggccacccagtcccacttcaaacattcgtctcggaaaccccgcctcttacagtcacgagctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaaaaaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggc

SEQ ID NO: 23534 - DNA, 8758 bp, Homo sapiens
  ENST00000535170
ggtggtgacacgcttccggcctttgtgactcattgtgtctgtgtcgaggcgtcgggagggcctaagtccgtgtgcggtgcccttcggccggcctgagccccagagtcagctcccctttctcgcccagcgcccccaggccgctcccggggctcacgctcttcctgctgcccacattcctgcaccccctcatgagggtagtcccagagaccaggcgatggcatctgcactattcacagcggattcccaggcaatggtgaagatcgaggacatggctgtgtccctcattctggaggaatggggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaagtaggacaagggtcctacccaaggctaggaccgccctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatctcaaaaaaaaaaaaaagaaagaaagaaactgaaaagtgaggtgtggaactccaggcaacgacccaagcacttattttttaagagggaaaggactttggtcatgtttacattggcctttggtttttttttttctttcagccacaactatatgctgatataactcagccatcacttttgagttttgtttttaaatgaaggttaaatgtgacctgtgccctcacatttaattccgtttcatggagacatcttcctgactttgttggatagctgccactagggttgcttcgatcttcagccacatgctgtccttgaagcagctatttgaagatgtgttttctgaggaaaacaggctacaactgtttattaaaaccacttgcagtgcattcgtttatcagatgctcagtgcaaagtgtaattgggtcatggtcaaaaacgcttgcaacatctaattggcgttcaagatagtcattcaaaagttcttggcccgctgaagtctgttaacagttgaaacattctacagttaaccattagcatgctagttgtcctaatggaaatttttgaagagtttttcaatatataccctacccttgccaggaagagaagtaaaatcctcaggttgtggggtatttgtttctactccagcctggcaggcaaggctaaaacctgagattatcgatctatgagacatcttgatatgtaaagcacttaatattaaaggcataaaagtgaaactgctaaatatgtatagagaggttgacgtgtgatacgtgggacagttcacatagacatcagagaatttattccagaaaggagcctcctgaatgtgatgaatacggcaaagcctttaatcacatctcagcccttagcatcggaaagcttatactgtaaataaacttgatgaatattatatgtgaggaaaactttcatgtatagcactcattgcttcagacagaaaatgaattccgtcggtatgttccaatcgtgatgaatttgagaaacattgcaagagggagctcaatcttggccgggcgccgtggctcacgcctgtaatcgcagcactttgggaggccgaggcaggcggatcacgaggtcagtagttcgagaccagcctggccaacatggtgaaaccttgtctctactaaaaatacaaaaaaaaattagctgggcacagtggcgcacgcctgtagtcccagctactcgggaggctgaggcaggagaatggcttgaacctgcgaggcggaggttgcagtgagctaagatcatgccactggcactccagccttgagtgacagagcgaggctctgtatcaaaaaaaaaagttgcgggggggtgctcaatcttaactgcagaggatctacagatgaaaaaaaatgtggggaaatgctttaaaaaaatagcaaaatgtgcaacttcttacaaaaattgttaacgttaggtacttctatatattttatatgaccataatgtccgtgtgtgttttgtaccttcagtcccttgttattgttccgtatattacctgtaagcagatactgtattttattttagcctatttgacagaacacatcactcagaaaaagtgaagtttcagagcaaacagtgaagaaatcagtgtgattgtagacaaaaagtcggttcacagaacggagcagcggggagaggaagggaaaagcttcatagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaaaaaaagaaagaaagaaagaaaattggggataggagaacagcaaggtgggcatttcccggaattgtgtgcagatgcatccagtcgtggcattgcaagaagtctgtctgatgaagctcgggaagcattttgcaatattccctttggctgtgttcctgtgttccctgctcccacttttcttcccctggtttgtgattattaggagagaggttttgcaaagactcgttgctgtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggc

SEQ ID NO: 23535 - DNA, 2250 bp, Homo sapiens
  ENST00000315769
cgctagcacagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaacaaaa

SEQ ID NO: 23536 - DNA, 2466 bp, Homo sapiens
  ENST00000297737
cagttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaatgagatggaaataaacaagtatttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaac

SEQ ID NO: 23537 - DNA, 690 bp, Homo sapiens
  ENST00000519406
ctttggaccgttcacaggctaattgggaaaagtggacaggcctgcctgaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaaca

SEQ ID NO: 23538 - DNA, 661 bp, Homo sapiens
  ENST00000519806
cagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtaagggcagctcttctcacttctgccacaaaactgggctttcagagaaaagatgcggctttcacaaatcggaatgattcttcttcttgctttaattattaaggaaaaagtgaggctcacccaaaagaaatggacaagaaaggaaatgagcagaaggcttgctttagtttaatttttataatctcctttgtttcaaagtgtttattttcatatttttattgactgcttttcagaccaaaggcacattcatgaaccagattgttttccttctgctttatctttaactgccttctttaccaaatgcttttgtagagtagcagtgtttaaaaaagaaaaaaaa

SEQ ID NO: 23539 - DNA, 590 bp, Homo sapiens
  ENST00000518242
ggtccagaattcttgaggaaggggaatttcattagacatactaagccaaaagaagatgtcacactgaagaaggtggctgtgtgaattctgacccagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacaggtacgtgcaggaacagtgatcgtggggagaccctgaaaaccaagtgctggcctgtcttgcagatcatgctcctccttcagacgcagttgccagaaccagagcctaatggtagacgtcattcaaagcctaaagggatgagtggctgacctcagcagacctggctgtcctaagacccctaaataccatttcaggtgctcattctatcaccctagttcctttcgatgaagtaatgcagcagcttgcatctgc

SEQ ID NO: 23540 - DNA, 564 bp, Homo sapiens
  ENST00000523188
agttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagggtccagaattcttgaggaaggggaatttcattagacatactaagccaaaagaagatgtcacactgaagaaggtggctgtgtgaattctgacccagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctagga

SEQ ID NO: 23541 - DNA, 515 bp, Homo sapiens
  ENST00000523542
gccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagtgtggtgcagttcctctgggaatgagcaatgtaacttaaaactagctgtgtcaataagtcaagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgct

SEQ ID NO: 23542 - DNA, 473 bp, Homo sapiens
  ENST00000522623
gaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagtgtggtgcagttcctctgggaatgagcaatgtaacttaaaactagctgtgtcaataagtcaagggtccagaattcttgaggaaggggaatttcattagacatactaagccaaaagaagatgtcacactgaagaaggtggctgtgtgaattctgacccagtcgaaaacatgcaagcaaagtccgactgtattacatgcttcaccccagggatggagggtgtcctgccaagaggctccggtcag

SEQ ID NO: 23543 - DNA, 571 bp, Homo sapiens
  ENST00000523823
agtagatattttaggctttgcagactgcacagtgtttactgcagctactcagcattgctgctgcagcacggaagcagccatagaggacatataaatgaaggagcatggctgtattccaataaaactttatttacaaagccggaaacccacccataggccataggtttgctgaccttggatccagaacactggagaggaaccagcaatggggactgaagcaggagcagcctggagattggggtggaccaggagaggaggttgcttcagaaactaagcaaagcatttttgcagaagaaagtagtgatctgctgggtcaaatcctgctggcataagaagtaagatgaggactgaaaattgcacgtgagcagtgtagaggccgtggatgagctgatgaaagcactttggttgaggatgagcctgatgaagtcctccgatattgatcaggatttattcacagacagttactgcaaggtgtgcagtgcacagctgatctccgaatcgcagcgtgtggcccactacgagtgtggtgcagttcctctgggaatgagcaatgtaacttaaaactagctgt

SEQ ID NO: 23544 - DNA, 546 bp, Homo sapiens
  ENST00000538918
gtgcgtgacgtcaggccacggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatg

SEQ ID NO: 23545 - DNA, 648 bp, Homo sapiens
  ENST00000540609
ggccacggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtggaaacattaaagaatgtgcttcagagagaaaggaaatgaaaccaaatggaaatctggatctacacaaacgagtaaacagcactggcgaatggtaactacctagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactat

SEQ ID NO: 23546 - DNA, 4441 bp, Homo sapiens
  ENST00000248211
acggggaggtggcgccgccgtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaagagcaatgactttattttgcattggagaactcctggagataagctgtacaaattgaatctatgtggaaatgctttcagtcttgttactatcctattgcacattagagaattggtcctggaagggaaagaaaccacagattttatttcagtacacaaatccatcagattttcttcttttcatgaattcctacagaagtaattggcctgagagcattcttgaccaagtcttaaatgctagaatctgagaaggaattattaaataggtgagttgttgagcgagaaccccttcatttgaaaagaaatgagtatgctactatagggagagttgttgctgagaattaagaaatgatacagttaatgcaacaaaagatggaaaataatatttcagtcaatatgtcattgttttcttgactatgtctctcttctgggacatttagtagtgtttggtatgttttatgtgtctggtagaaaccatattttggttaacagcaagaaaaatgcttataatgtagtacaattaaaaacaacacatctccactaccagtgctaacccatttttaagtacatttgcatgtgggcaagaattgaaagtatacagataattgaacagaattgatttgttagataaggagattttgactgagttttatagtctgtttaatgttgctgtaataattattttaagaaacttttaaatattgtaagaggatatctagtttctctattctaccatcaaagaagcttttgagtaccacctgttaatgagctttcctattctaaattgttttgggtcacagagttccactttttccactcttattagcactgcaaaagctcctgagaatttaaaaacacagtaattctctggatgttaggacctaggggaacattgggcatttgaacatatcagggagggtccccattttagtgggaacaagtatttaaacaatatttagagcaagtgtcctcatgtgataaacagagcacagtccaaagataccctctttctcaaggtagtcttttatctttataaagaaagattagtgtttaagagcgtagacttgagctagactacccaggttgaaaccccactagctgggtgatcttgaacatgctgcttagcttctctgtgccaaacttactgatatcctcatctgtaaattagcgataataatagtacttacctggtaggattatggtgagtattaaatgagtaaatggaaacagcttagaatagtgcctgacatatattatgttctctgtagttactggctgtgattattaataatattgccgcaccctaatatctgttatttaattgaaatctgcttgtgtgcttataagaatttactgagttctcacttcccttacagtcatacatggtttttcccttttgcctaaatcagaactcaacagcctgggaaaatcactgacaaatagtggatataggtttcatttctgaggatcaataaacagcttgtaatgttgtatacacatttattctgtttgtacaaaggttttccattctatggagaggatcccagtcttcagattctctggtaagttaataacccacaaaagattcaggaagaggatctattttaattttctctttcattctataaatcagtctgttgtatatagggactgaccatgattctccattttctggcataaatattagctgctcaatgattgattgttgaatgatagatgaagtattgctgaagccaaccagagatcttgatctctctctgaggaaaaaacctagaaatgatggttagaatcaggagacttgagaactacgaggaacatggcagcctctagctcatacttgtcgttgtacaattgagatcaagtgaattggccccggtctcacattttcagtgaagtcagactcagaactaggtcctgggtttcatgtttcctgctgctcttctcactgtgtacacaccatgcccacatacaacatacctatcagaaatggttttcattaagggagtagaatagtcacttaactggggctcttaacattgctaataacctgtggctcaatttcctcaactgtataatgaggttactactagtatctacctcaaagcgttgtcatgtggattgagatgatatgtatgaatcacataaaagagtgcctggcacatagtaggtgccattaataatattactattgttaacaccttaagggtctaacttgtaatgaagacagaaatatgtatgaggatgatcactgaaatatttatgacagtgcataatttgcaaaataaaaaatgtacactagcataatatttgtggcatatccgtgtaatggaagattatgcaggcattaaaatatgtacacaaaaagtttggtaaaggaaaaatgctgtcatgtgttacaaaagcatgataaataattgttaatatggaataagctcaaatatgtcaaaataaatgtaaaaaatgagtgttgcccaaaa

SEQ ID NO: 23547 - DNA, 559 bp, Homo sapiens
  ENST00000543271
gtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcaggtatatacgaaagtgctgaattttgtgtttgcatcgtcatcaggcgcgtgttgagccctttagtaatgtagcagtgtattagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacggagtcttgctctgtcacccaggctagagtccagtggcgcgatctcagctcactgcaacct

SEQ ID NO: 23548 - DNA, 590 bp, Homo sapiens
  ENST00000540927
gtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtggaaacattaaagaatgtgcttcagagagaaaggaaatgaaaccaaatggaaatctggatctacacaaacgagtaaacagcactggcgaatggtaactacctagctttgtctcctcagcactctgctgtcactcaaggaagtatcatcaagaacaaggagggcatggatgctaagtcactaactgcctggtcccggggaggagtggaagctgctggacactgctcagcagatcgtgtacagaaatgtgatgctggagaactataagaac

SEQ ID NO: 23549 - DNA, 531 bp, Homo sapiens
  ENST00000536704
gtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcaggtatatacgaaagtgctgaattttgtgtttgcatcgtcatcaggcgcgtgttgagccctttagtaatgtagcagtgtattagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgacactggtgaccttcaaggatgtatttgtggacttcaccagggaggagtggaagctgctggacactgctcagcagatcgtgtacagaaatgtgatgctggagaactataagaacctggtttccttgg

SEQ ID NO: 23550 - DNA, 472 bp, Homo sapiens
  ENST00000536877
gtgccgagccggcctcagactcacctctgacgccgctcttcgcgctccgctggtgaatggagtcgcgttctctgttttgctgttgctgctgcctttgtgacgggatcgctttctcccatcgaaccttctagttgcttattgcagtggctgtgggagcaaagagtaagaaacactaaaacttcctggagaaattagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctg

SEQ ID NO: 23551 - DNA, 2169 bp, Homo sapiens
  ENST00000426665
agactcacctctgacgccgctcttcgcgctccgctggtgaatggagtcgcgttctctgttttgctgttgctgctgcctttgtgacgggatcgctttctcccatcgaaccttctagttgcttattgcaggtatatacgaaagtgctgaattttgtgtttgcatcgtcatcaggcgcgtgttgagccctttagtaatgtagcagtgtattagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaa

SEQ ID NO: 23552 - DNA, 1967 bp, Homo sapiens
  ENST00000402932
cactttcaagctcactcttcttggcagaattcagttccttgtggctgcaggactgaggtccctgcttcctagctggctttcagctggtgctgctctttgctgctggagcctgccatgttcctcacactgcattccatcttcaagccagtaatggtgcgtcacatttttcttgggcttctatctctgacttccgttctgtgaccagctggagacaacacttgtttttttaatctgtaaagtgagactatttgattaggtcaggtttggtatttttttccgcaaaaaaaaaatttgtaatggtaggtaggatcattcagttttaaatcttcaaatgtggtgtggaactccagagattaagggggtaaaaatgcaatttatgtagctcttctcttcctaatcttggggagcttcgggcactgtagatttgcttatagaatatctctgatgttcctctgtatagtgggtgtttgtgtcatacccagctggtatgaagaagtttagactgacaatttagggagcctcccagtcatagcaaacttaacttatgtttctttctttttcccagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaa

SEQ ID NO: 23553 - DNA, 711 bp, Homo sapiens
  ENST00000537119
gatgcatatctggtgcaatgcaaatgtgtttgatgttgtagacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtg

SEQ ID NO: 23554 - DNA, 2243 bp, Homo sapiens
  ENST00000472531
ctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaaaacggctcacgtaggccgggcgcagtggctcacgcctgtaatcccagcactttgggaggccgaggcgggcagatcacaaggtcaggagatcgagaccatcctggctaacacggtgaaaccccatctctactaaaaatacaaaaagtagccgggcgtggtggtggatgcctgcggtcccagctactcaggaggctgaggcaggagaatggcatgaacccgggaggcggagattgcagtgagccgagatcgcgccactgtactccagcctgcgtgacagagcgagactccgtctcagaaaaaaaaaaaaagaacataatatgtgtattgtgtctcatgtacactgttgaagaggtagcagcccatgattgatgaaatagtccagtgatcttatgagatacaagtttgttttcatgttctctctctgacattgtctatgcttagttattgtgttcatgcttattccttcatggtccaagttggctgtcccacctccaggcatcaaaccacattccaaacagcaaccaggaggaaatagtaagctgataggtcatggggaattaggttggaagccattgctttttaatttacagaagtccattctccccaggcacttctttctaagtctcattgatcagaactcaaccacgtggccaccatcagcagaaacatctctctgtagcaccgtgaaacacatgagaacataactggggatgaccgttgttacttgaactattttgaaagatctgacataaaggtcatcgccttgtgcacttcaatgggtgttactgcaaaactcccagggctaggcatggcgacatacacccgaaatctcagctatctgggaggctgaggtgggaggattgcttgagcccacgagtttgaggctgaagtgtgcctgtgaatagctactgcactccagtgcctaggacacatagggagacctcacttttttatggctgcatagtattccatggtaaagaaatgtaccacattttctttatccacttcactgttgatgggcatttatccacttcactgttggtgggaatttaggttgaatccatgtctttgctattgaagtcacactttttaatcaagttatttaactttcctgtgttcatttgtgttatataccagaacatttttatttctatggttttaatgccacctaatatgattatcaatgtgtcattctccataaatcattgtgttatacatgttaaacgattaggtattaagtgtataggtataaatcacttagaataatgactaacacattgtatgaactaaataagtactgattcatctgattcatcaaatttccattattcataccattcattatttattaagtggtgtagtatttgttcttatcaacatttgcttttctgtcctatctaaatattaatgaaacagtggatgtgggctcagtgtgctgtcttgaaataatccaaagtcaaatggcatgcttcactggtttcctttagatgcaataactcatttgactcacacaataaaaatgagtattaagta

SEQ ID NO: 23555 - DNA, 504 bp, Homo sapiens
  ENST00000476312
cattcaggatgtcatcttgaaagcagagaccaaggtcttcaccagagacagtctgccaatggcttgattttgcacttcccagcctatataactatgtactggttcatgaagatgtgcttatgggtttctactctaatgaggtttatataactttccaagacaaggaagttgtgcaaagcctcacagctactaagaggctgggctgggactcaggattaacttcgtgactccaaagcccatgcacctctgcaagccacacgaatcaagcagcttctctaaacctttgaagtcctggaaagtaactcttctgcaatagaagcaagaatcctgtgagattgggatccatctagtactcttcaccatttggaacaactgcctccagagaatgcttctgacgcatcttggaagaacttggaataacctgaggaaatggtcgatttgctaatttaggaaaccaatgttcgatacgtgtgtgatcccaataaagctattaacaaaaaacgg

SEQ ID NO: 23556 - DNA, 956 bp, Homo sapiens
  ENST00000491356
gtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagatgtactggttcatgaagatgtgcttatgggtttctactctagtaagttttgggtctatgtatgtacctttctttctctgcactcttggggcaaggaattgccatgtgattgatcggagaattgttcattttaaattagtccagaatttttatgttttatttcttctaaaacaaacgaaaacgggatacgtgtagaacatgtgagtttgttacatgggtatacatgtgccgcggtggtttgctgcacctattgacctgtcctctaagttccctcccctcaccccccaacccccaacagcccctggtgtgtgttgttccccctctgtttccatgtgttctcaatgttcagctctcacttatgagtgagaacgtgcagtgtttagttttctgttcctgtgtttgctgaggatgatgacttccagcttcatccatgtccctgcaaagcacatgatctcattcctttttatgtctacatagtgttctatggtatatatatacacatatatatatacaccacattttctttatccagtctatcattgatgggcatttgggttggttccatgtctttgctgttgtaaataatgttgcaataaacatacgtgtgcacgtg

SEQ ID NO: 23557 - DNA, 1674 bp, Homo sapiens
  ENST00000340684
ggcctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttg

SEQ ID NO: 23558 - DNA, 1292 bp, Homo sapiens
  ENST00000543802
cgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaaggcacatcatatctcattctggaaacaacccatatgggtgtgaggaatgcggaaagaagccatgtacatgtaaacaatgtcagaaaacttccctttctgtcacaagggttcacagagacacagtaatgcacactggaaatggacattatggttgtacaatatgtgagaaagtttttaatattcccagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatga

SEQ ID NO: 23559 - DNA, 701 bp, Homo sapiens
  ENST00000491848
ctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgatttccagtgctttcagtctcatccatcctctacaaaaatgtggaatattttagaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtg

SEQ ID NO: 23560 - DNA, 750 bp, Homo sapiens
  ENST00000503599
gacactgaaaatcagtagaagaaatacgccacatttattctaccggggaagacagtgggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagagtcttgctctgtcacccaggctgaagtgcacccaggctgaagttggaggctatggtgagctgcaccactacaccactatgggaggccgaggcgagtggattgcctgagctcaggagttcgagaccagcctgggcaacgttgtgaaaccccgtctctactaaaacacaaaaaattagccaggcctggcggcatgtgcctatagtcccagctactcaggaggctgaggcaggagaattgcttgaacccgggagctggaggttgcagtgagccgagattgcgccactgcactccagcctcggtgacagagtgagactccgtctcaaaaaaaaacaatataaggtgaaggccaagcagggtggcacatacctgttgtctcacctactcaaaaggctgaggccagaggaggattgctggaagtgagttcaaagccagcctagagaata

SEQ ID NO: 23561 - DNA, 990 bp, Homo sapiens
  ENST00000499046
agtgaaagactcaatgcctcctgaccgaggcttcaggcctgccccggcagctaggtacctctccaggggatggaactctgtgggaactgctatttaattctgatggttaactctgtcagatggccttgatatatgggaataatcgttgcaggagggtaggggaaataagaatcgcaagactctagcacaggacgtgtggattgatggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagaggaaaccagccctaacaactctgaggcaagaagaggcttcaggactggatatgggacttaggtgacagaaagtctcctacctcttcaaaagcacaaacatactttatttctgttaaagaaaaaatgtaacacagttgttaggatggtaaagcagacttcattcagcattattgccataggtgtactttgcagtagaggattgagattgggatcagctcctaatacaaggaaaataagggatttacagccaaagactgagaggtagggatggaacgtggggcaggacaggggttagtgaatggaaaattactaaaaggatacgttaattttttctaaagtgacctaacagtattcttgctataggcagaccagggtgatcagatatcaattggagaataaggaatgtggtcagatatcgagggcgaatcagatattgaagataggggatgctggctaaaactgggctcttgaggcaatgtccaaggtccaagcataggtgggaaaggggtgaggagactgtgtctagggtttggtcaa

SEQ ID NO: 23562 - DNA, 465 bp, Homo sapiens
  ENST00000508795
gaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagagtgagactccgtctcaaaaaaaaacaatataaggtgaaggccaagcagggtggcacatacctgttgtctcacctactcaaaaggctgaggccagaggaggattgctggaagtgagttcaaagccagcctagagaatatattgagactctgtctctaaattttatatatatatggtgaattcacctttaccatatcttttatgtataagcaatgggattgattagcaagtaatgggactctgaaatcaaaggggtaaatttgggtagatctttataaatataataaccttgaacccca

SEQ ID NO: 23563 - DNA, 583 bp, Homo sapiens
  ENST00000507393
atcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagagctgccatgtcctgtggagagcctggcatgaacagaggccttgcggagaactgaagccttcagtccaagagccagggaggaactgaattctgtcaagaaccacttgagtgaccttggaagcagatcctttcccattggagccttgagattaaagccaccttacctgacaacttgataggagccttatggggtctcgctatgtgcccaggctggcctcaaactcctgggctgaactcctcctccccaactcggcctcccaaagtgctgggattacaagcgtgagccaccgcgcccgcccacatctcttcttacagagcagcccgacggccatggaggctgaagagacgatggaatgccttcaggagttccctgaacatcataaaatgatcctcgaccgattgaatgaacagcgagagcaggacc

SEQ ID NO: 23564 - DNA, 476 bp, Homo sapiens
  ENST00000514169
taatcctcaccctagcttatcctgttcaaatcatttccatctttttctggatgaacctgggcggatgtcagaccagagaagagcacagaatgtaccagagagagtcttgctctgtcacccaggctgaagtgcacccaggctgaagttggaggctatgatgcggtgatgggagccatatacacaaagatgaaggactggctacagctttcacagaccttacaacctactgagagagcaaagacacagtgaagagatcattcagaatacagtccaactccaagatcattgggagagcttatttgaagaccagaaaggttactgaacatggtgactctcttcaaagccagacctttgtccttgaatttagggcttcaaaaaacaatagtagggccgggcgcagtggctcatgcctgtaatcccaacactttgggaggccaaggtgggcagatcacctgaggtcaggagttcgagaccgg

SEQ ID NO: 23565 - DNA, 1050 bp, Homo sapiens
  ENST00000515326
gaacgtgctcgcgcccgtagctgccgctgccggggccgcggccgcccgggtgcccaaccgaacgcacgtgcgccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcg

SEQ ID NO: 23566 - DNA, 2599 bp, Homo sapiens
  ENST00000510026
ccgcggccgcccgggtgcccaaccgaacgcacgtgcgccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaa

SEQ ID NO: 23567 - DNA, 565 bp, Homo sapiens
  ENST00000504359
gcggccgcccgggtgcccaaccgaacgcacgtgcgccagcggggcccgagcagaaggggagccccggctctcacgaagaaaatggagggcgacccacgggttaggggtcaggaaaggcgtggggcgcattatgccctgggaggggaaagcacggaacaagaggctctgagggacggagaggaaggagggcgacccacgagctagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggaacaaagaaaactcagctcccttagaggaaaataccacaggaaaaaatgaggccaaaaaaaggaagattgcagaaacttcaaatgttatcactgagtcattgccatctgcagaatcaga

SEQ ID NO: 23568 - DNA, 2063 bp, Homo sapiens
  ENST00000509156
gcggtgacggtgtgcgtcgacagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattc

SEQ ID NO: 23569 - DNA, 501 bp, Homo sapiens
  ENST00000508259
gtgacgcgcaagcctgggccgctcctccttccctcacccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaa

SEQ ID NO: 23570 - DNA, 1352 bp, Homo sapiens
  ENST00000507218
acgcgcaagcctgggccgctcctccttccctcacccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttca

SEQ ID NO: 23571 - DNA, 2400 bp, Homo sapiens
  ENST00000306938
gcaagcctgggccgctcctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgtt

SEQ ID NO: 23572 - DNA, 3209 bp, Homo sapiens
  ENST00000505606
gagaagagggagggcgggggagggagaggcgacccgagagtcgttgtgggtcgcgggccggaccgggtcccggggcggtgggagccccggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccatagaccaatatgctattttttttacctgttaaatattgggagttctttacattttttaagtaaactttaaaattatgtg

SEQ ID NO: 23573 - DNA, 3340 bp, Homo sapiens
  ENST00000509634
gaagagggagggcgggggagggagaggcgacccgagagtcgttgtgggtcgcgggccggaccgggtcccggggcggtgggagccccggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattaggtcaggctcggagtcccgcggccgcggctccggtctcaacgctccggggccgctcggctcgcctttcttccctcgcctttctctcctcttgcttcaccctccccccttcttttcacgttgctggttttttttgttgttgttttatgctttaggggttttgttcctcggctcgagctcatgggtgtacattatcatgctcttcttttgtagagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaacccata

SEQ ID NO: 23574 - DNA, 572 bp, Homo sapiens
  ENST00000509341
ggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaa

SEQ ID NO: 23575 - DNA, 970 bp, Homo sapiens
  ENST00000509931
agcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataatactttatatttttggttataatgacaaccaccagttctttttcacttaagttaggttgagaaattttatttaatggccactgaagggccattttcaattgggaaaatttatttacatctgtggtaaactttattttgatgaaaagttgcactagtattttaccaccagatgagaaaaagatgagcagcatttaaaaattaatgtatttaaaataaagtacagagaaagacatgtatataattatcaggctttgttttgaatggaatcttttcccccaattcttaatgtaaagatcttgtgctataacttttaaagccatacaaataagagtgctaaactgtggacttaaaagtaggtgtgtaaatatttttaatcagtattacttggaaaataaaatataacaaaccc

SEQ ID NO: 23576 - DNA, 956 bp, Homo sapiens
  ENST00000511736
agcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttgacagggtctcgctgtgtcacccaggctagagtgcagtggcacaatctcggcttactgcaacctttaacttctgggctcaagcaaccctcccacttcagcctcctgagtagctacgactacagaacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatcacccccctccccgagcgactgcactgggtgtc

SEQ ID NO: 23577 - DNA, 1927 bp, Homo sapiens
  ENST00000510037
gttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtaaatgattcttgttgtttttttatttaataaatcaaagaagccattttatttaaatgcttgttttaaatacaatacttagcaaacaattggtgaagcagttttagacagtttatcaagacaccataggaaataggcatcagtagttcctgtaggtaaaggtagataaattgttcttttgatacctgagaagtcttactttcagtgaagtgcttggttgaatgatctgccaggaaaaacttagatggtagatgttggtcttttccattgtggaaactggtggtcattgttttttgaaaacaagtattaaacgtgaattactatctttgttcagtgggcttatgtttcagactgctggagatgctgcaggttacagtagaagcttttactgtactctatagcagaagtagtgatgtattagcagaggtacagatgacatgcagtgtgaagtgggctgccataatagggagaaagctaggaaaaatgaactgaagtagcatttagaggaaattctggctctacaatgggatggatcaatacctgttaccttgaagcaaaaagtgatttttgtactttctagacatttttctaataataacctgccaagtgccaggcgttgtgatatgtagttttgtgtattgtctaaggctcacagcaatcgtttgatgttgggcaggatggcttgtgcttgtagtcccagctactcgggaggctgaggcaggaggattgcttgagcccaggagttcgaggccagcctggggcaacatagaccctgtcttttcttttcttttcttttcttttcaaaaagggaagtggtgttatttgtaataatttacacttcaggaagcaggctctaaaaggttacttgcccagggttgtccaactagcaaggaattaagtttgtgctattaattaccatgctttttcttctgctactgcagtaactcctcccctaccaccagcatcaaaatctaaaacagcaggaaataaatgtttgcctacgtaattacagaattttagcttcttttagggttcttgggttttggttttatatctatttcattgtgtacgtattctttgttctgaatgggttgcctagaaactccttttttccctttgatgcctaggggagtaaagaaaacaaaaaagagttaagaatattctttaattttggtatattccagtttagcattatagctgatatatttacagctagagtatcttttaatatctataatcaggacagagacataattatgaaaatccacaaaacttaataaagtgagaatctaactgcccagatgatagtggtttctactacaaagcaagcctccatgaattcattcacacctgaggtttattaaatatgtgaccccaggcgggttactttacctcaattgcatacttttctcctcatctgaaaagtgggttcataggattataaagactaattgcgataacatgcagagtgcatggcatgatatttggtgccttgtcaaagcttgataaacagggtccagtctaagaaacattagggagacctcttctctacaaaaaatttaaaaaattattagctgagtctgatggcacatgcctgtggtcccagctattcaggaggctgaggcgggaggattgctggggcccaggaggtcaaagctgcagtgagccatgattttgccactgcattgtagcctgggcgacagagcaaggccctgtctcaaaaaaaaaaaaaaaaa

SEQ ID NO: 23578 - DNA, 760 bp, Homo sapiens
  ENST00000502623
taagaagcaaagaactgggaaaaaaattcatgtatgtcagtactgtgagaaacagtttgaccattttggacattttaaagaacatcttcgaaaacatacagttctggatgctaagaagttcactgttatgaggccacatctggtgagagccctgccagtggcgactctgcagagtcctgaggccatgcagggcatcacatggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttaaaaaaaaaaaaaaatccacacccatgtgccttctcaaaaccaactgaacttctataaagcatctctggttctttcaaagtttgtgttgtaaggagcaatgtagatgatgctataa

SEQ ID NO: 23579 - DNA, 538 bp, Homo sapiens
  ENST00000507231
ttattatttttgctacctctagaaaagtctttggaatatggtgaaaatatttgaattctgaattgtgatttctccttttaggaatttagtattaaaattacccaaaaagaaaaagtaaacgtttaaaattatttgctcttaggatttttcttaatttgccaacgtatcttttttcccctctaataggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaat

SEQ ID NO: 23580 - DNA, 536 bp, Homo sapiens
  ENST00000366506
gtctttgcgtctggctactaccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatgctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagaga

SEQ ID NO: 23581 - DNA, 1611 bp, Homo sapiens
  ENST00000512994
gcgtctggctactaccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagcccagaagaatggcccggctgagcccagcctaaatttctaaccagctcaatcctgagctagtatgtttcgggattgttatgcagttataagttagtaatatatacacccattaaagacaggatctcaggacagattgatcacaaataacctgcaaatgcttgccaccctgtaagtattgattttcttttttcctttatttaaagttagatttgttgtaagatgatattgagttacacagaagttaggcaggagaatagggtttggaggcagggaacttaaggccaattcgtgctgacttcctacaagaaaaaacaccaaggtctgggagcagggaacctaaagccagttaacgtgaacttcctacatctaaaccaaaaggaaagacctcatctacacccgagtagcaaaggatcgaaggcgactgtcgctacaaccctcccccttgtaccagttctctgatagaaaaggacagtgccttggagtggccgtgggccaagcacaggccatgccttcatctgcatagggtaccaattcgcctcaacctttgattagccaaggaccaaatccttcattcagataaggggtagctgataggaacctcaaaaggagtacttaaaacccagaaaacattgtaaccgggtccttgggcggcttgctggggctcacacccaccctgtagagtgctttctcactttaataaaatcttgcttttgcta

SEQ ID NO: 23582 - DNA, 720 bp, Homo sapiens
  ENST00000503699
accagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagatggagtttcgctcttgtcacccagactggagtgcaatggcacgatcttggctgactgcaacctctacctcccgagttcaagtgattctcctgcctccgcctcccaagtagctgggattagtcatgagccaccacacctggctaatttttatatttttagtagagatggggtttcaccatgttggccaggctggtctcgaactcctgacctcaagtgatccgcctgcctcagcctcctgaagtgctgggattacaggtgtgagccattgtgcccagctctccttcttttttataactcattttgttcatgcattgttgcaaaaaaaaattagtaatctgtgta

SEQ ID NO: 23583 - DNA, 2146 bp, Homo sapiens
  ENST00000505939
ccagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagcccagaagaatggcccggctgagcccagcctaaatttctaaccagctcaatcctgagctagtatgtttcgggattgttatgcagttataagttagtaatatatacacccattaaagacaggatctcaggacagattgatcacaaataacctgcaaatgcttgccaccctgtaagtattgattttcttttttcctttatttaaagttagatttgttgtaagatgatattgagttacacagaagttaggcaggagaatagggtttggaggcagggaacttaaggccaattcgtgctgacttcctacaagaaaaaacaccaaggtctgggagcagggaacctaaagccagttaacgtgaacttcctacatctaaaccaaaaggaaagacctcatctacacccgagtagcaaaggatcgaaggcgactgtcgctacaaccctcccccttgtaccagttctctgatagaaaaggacagtgccttggagtggccgtgggccaagcacaggccatgccttcatctgcatagggtaccaattcgcctcaacctttgattagccaaggaccaaatccttcattcagataaggggtagctgataggaacctcaaaaggagtacttaaaacccagaaaacattgtaaccgggtccttgggcggcttgctggggctcacacccaccctgtagagtgctttctcactttaataaaatcttgcttttgctattcccttcctgtttttcattcctttgtgtgctttgttcaatttttttgttcgaaatgtcaaggacctggacagttcacactcacggccttccttctggtaacagaagtgcaggtatatgtggatgcatgtgattggtacttaaactcacacagtgccccataccacaggagaaaaacacacagttccagcctggcaattaggtccaaagataaatagcaaaacaagaagtttgcctttaatctattccctccacatctaaactctggagggcaaggctgtgaggagatctgaagacatggtgctctctcttcctgtggacccatcattccttgtttaccatctgatatttgaaaagaagaggaacccctgagaaaggaggcagaggctggttaggaagatagggagggaaggtcttgggagatgaaaaacacccacgggaccacacctgcaccacccatgtagctagcaggaagaaatgtggttaagaacttcctcttatgccagggtgttgatcagaagagactgtcccacttaggcccaggtgtaatgaatcaacctaaatgtcattaacttgacccagctccttataatgttactaacatgacataaatattttggttttagcttcactctttccacctgctgtcggttttgcttgggcactcatgggtaataaccaagatggagtcactgtggtcaactccaggcatgcacagatacaacacccttagcggggaaatttacccctcccatttgggcagaacccacagaagacttcctcgttcttgccacataaaagacccagaactcagccccatttctggcaacctgctttcatgtcccctttctgctgagagctttccttttgcttaataaatcctattctgcttta

SEQ ID NO: 23584 - DNA, 2970 bp, Homo sapiens
  ENST00000240499
cagaccgcgggttaggggcttcatctctctgcgttctcagttgtgggaggccttggtgattcggccacagctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttgagagaaatcctacaaatgtaaagaatgtggcaaacctttggatgatccacaaaccttaatgaacatgagaaaatttatactgtagagaaaccctggaaatgtgaagaacgtggcaaagttctttacctcattctcaaaccttgataaacataagagaattcataccggagagaaactgtacaaatgtgaagaatatggcaaagcctgtgaatggtccacaaacctgaatgagcagaagaaaattattactggagataaaccctgcaaatgtaaagagtgtaacaaaacctttaaacagccctcaccggtgaataaacataagaaaaatcatgctggagggaagccctacacatgtggcagaatgtggcaaagcatttaattggtcctcaatgcttaataaatataattcatgctggagagaaacttcacatgtgaaccgtgtggcaaagcctttaaatggtcctcaacccttaatgaacgtaagtgaattcatgctggagcaaaatgcttcacatgcgaagaatgtggcacagtctttaccacatcctcaaactttgttaaacataagagaatttataccagagagaaaccctacacatgtaaagaatgtggcaaagccttcaataggttctcaacccttactgtgcacaagataattcattctggggaaaaaaatgctacaaatgtgaaaaacgtggcagagccttcagaccatccacaaacctttatgaaaattcatatttgagagtagaagattcattccacaaacttacattgagaagatatgaaagatgaatataagaattcatcctagatataaaaccatagaaatgtaaaagatgtgacaaaacctttaagccatactccaggcttcttaaacataatgagaactcatactggaggaaagtcttacaaatgtgaagaatgtggcagtctttaaatcttcctcagtcttttctaatcataagataattcacactgaagagaaactgcaaacgtggaaagtgtgacaaagcttgcaaccacactcaatctattctaaatataagagaaatgatattggtgagaagccacaaaaatatgaaaaatgtggcaaagccttcaaatgcttgtcacatcttactgtatatatataattcctactgaagaaatcccctggaaatgcaaaaaatgtggcaggatttttaccaatgctcatctttttgcacatgatatcctttatattcgagaaaagttatagaaatataaaaaatatagaaaagtcatatctcctcacattttactaactagcaatgttcatacttaataaaaacattataaatgtaatttctgttgaaagacttcagaaaatataggcctttaaagtgaagaagagtattcttaagacaaacaataca

SEQ ID NO: 23585 - DNA, 814 bp, Homo sapiens
  ENST00000579770
cctgtagtcccagctactcgggaagctgaggcaggagaatcgcttgaacccaggatgcagaggttgcagtgagctgatgttgtgccactgcagtgcagcctgccaacagagtaagacccgtctcaacaacaacaacaaaaaagaagaaaatttttaggagacaatgtttttccaagagacttcagaaccattccctggagtgaattatttccaatggtgaagagtaatggatggatggcatgagattctcaaaaaaatcttgctcctatttcagaagtgtcactccagccccttgaaggtccaggaaacctggctgagtagtgtggtctatggaggtgcatgggcttcagaatcaggccaacgttgatcctgagtcccagccagctgcttagtagctgtgggatagttacacaagacacatctacaagaaaagtcatgataaaattgattgcaaaaacagcaatttgaaaaatttcttattgtattcatgtccttggaaatggcttttatagtcgttcctatcaagagacagattctgtttcccaaaccttgaacttctcttgacttatctgcactggcacagggtgccagtttggggcccaggtttaaaggtcctaaatgcttctgttatctttttcagaattcttccatctctatgacaacaagcccattttagctttctggagaatagcatctgagaaaagccaaagtgcctcagtttacagacagctcactcacagaagcagagccacctaattcaccagcatctaaccactcacacctgaaggagccaaactgagcccagaagaatggc

SEQ ID NO: 23586 - DNA, 2899 bp, Homo sapiens
  ENST00000377419
tgcacagagggaacacaccagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggatttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaata

SEQ ID NO: 23587 - DNA, 3101 bp, Homo sapiens
  ENST00000211936
gttgaagccggttgtaggcgtggaaagaggttggcgcgctggaagtccagttgcttcggctccctgcgttaggtctggtggcggtcaatgcgcttccggacccgggatcagagtgtgtggatcgctatagggggaggggagctcagggtagacaacctcagcgtgttgcagattccctgcaaggggagttagacatctgagtcctagaccgagataccagctgaaggaacgctgcctggcgaaccctggtgttcaagttccagaggaacgggatgagctcctgagatggaagatctgtcctctccagactccacccttctccaagggggacataatctactctcatcagccagttttcaggaagcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcaacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggagaaaaaccttttaaatgtgatgaatgtgataaaaccttcaccaggagcacacaccttactcaacatcaaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacacgagagaaaagccctttgaatgcagtgaatgtggaaaggctttcagttatctctcaaaccttaatcagcatcagaaaactcatactcaagagaaagcttatgaatgtaaagaatgtgggaaagcttttattcggagttcatctcttgctaagcatgaaagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagagactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggatttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaataccctcaaattaacaattcaattgcatataatagcctaactcagtaagaatattaaaacttactattattcttcttct

SEQ ID NO: 23588 - DNA, 2810 bp, Homo sapiens
  ENST00000335870
agaatgcacctggcatcaacacggcggcggcggcggcggcttccaacaggctctggggcgccgagcggacaggaacgcagcacgggggctccgaggcggggtctgggtgttgaggggcgactggagccatggcggagtcggcgcctgctcggcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaagtt

SEQ ID NO: 23589 - DNA, 637 bp, Homo sapiens
  ENST00000486371
ggcatcaacacggcggcggcggcggcggcttccaacaggctctggggcgccgagcggacaggaacgcagcacgggggctccgaggcggggtctgggtgttgaggggcgactggagccatggcggagtcggcgcctgctcgggtaaagaggcaccggcgcgctggctcgagggcgcgttggggatggcggagtcccctgccgggggcggggcttcgcggtttggacgccgccggggtcttggtttcccggggctgccgttggcgcgggtgaacgcggaccctcctcttcgcgaccccagtgctctgcccttttttccctccgcttccttctgcagcggggtcggagcctcggcgccgtgcgcccttgcccagaaacttctctgacgcttgctttagcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaacca

SEQ ID NO: 23590 - DNA, 860 bp, Homo sapiens
  ENST00000462724
caacaggctctggggcgccgagcggacaggaacgcagcacgggggctccgaggcggggtctgggtgttgaggggcgactggagccatggcggagtcggcgcctgctcgggtaaagaggcaccggcgcgctggctcgagggcgcgttggggatggcggagtcccctgccgggggcggggcttcgcggtttggacgccgccggggtcttggtttcccggggctgccgttggcgcgggtgaacgcggaccctcctcttcgcgaccccagtgctctgcccttttttccctccgcttccttctgcagcggggtcggagcctcggcgccgtgcgcccttgcccagaaacttctctgacgcttgctttaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgaga

SEQ ID NO: 23591 - DNA, 581 bp, Homo sapiens
  ENST00000481584
gtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgagttcaagcgattctcctgcctcagcctctcgagtagctgaaattacagaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagca

SEQ ID NO: 23592 - DNA, 559 bp, Homo sapiens
  ENST00000488917
ctgtttcaccgagcaggaatgggagaatctggaggattggcagaaggagctctacagaaacgtgatggagagtaactatgagacactggtctctctgaagtcttgctctattgcccaggctggagtgcagtggcacaatcttggctcactgcaacctctgcctcacaggttcaagcgattctcctgcctcagcctctcgagtagctgaaattacagaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggca

SEQ ID NO: 23593 - DNA, 3071 bp, Homo sapiens
  ENST00000360947
gcaccccgcccctggcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctg

SEQ ID NO: 23594 - DNA, 2918 bp, Homo sapiens
  ENST00000451119
ccactcttccaaggtgtcacaaacagaaaagagctgcagcggacgccactgcaatgtcaaggcaaggcagccaggctgcgctctatcctcactggtgcctggccctggctaggccgggagaagcagcattctctagggaaagaagccttctcaagtgggaacaaaaatgagtgtgaggcgaacagccatcccgggcactatgtgaatttgggctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggc

SEQ ID NO: 23595 - DNA, 2908 bp, Homo sapiens
  ENST00000421093
atcaagaacggaaaggaccgaagagtaactttaataatgtttcttatacggccgacattaactatctctataatcgcccctcctcctcccccaaaagagagacagaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgag

SEQ ID NO: 23596 - DNA, 798 bp, Homo sapiens
  ENST00000555270
cctgcagagaggaggaaagcctgcctcggaacagccctggacaaaggggctcagatgccccatcatactgcaggctccaagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggccc

SEQ ID NO: 23597 - DNA, 545 bp, Homo sapiens
  ENST00000554478
aaaagagagacagaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggagatctttctccacagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgccca

SEQ ID NO: 23598 - DNA, 546 bp, Homo sapiens
  ENST00000556174
gtgcatgttggggcagaaagagcggcagagccaactccttccctggtcttccagaactttcaaaatcaaaatcggggttgcgttaggacatgcctctgggataagattccccatggtgggatggcagcagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgc

SEQ ID NO: 23599 - DNA, 567 bp, Homo sapiens
  ENST00000554923
agtgtaatcctcctcttgtgtgagggagcctctcccctgcagagaggaggaaagcctgcctcggaacagccctggacaaaggggctcagatgccccatcatactgcaggctccaaggtttgaaacaaggggatgaatcctatacgctccacagcacctgttgccttcattagcagcttttcctcctcttccctgcacttcccagaaccaaagaatgtgaagggggtccatggagatctttctccacagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagc

SEQ ID NO: 23600 - DNA, 560 bp, Homo sapiens
  ENST00000553296
tttgagtatagcagccccttcgtgcctcaagaagcaagtagggagaatggattggttttgggaatacagaatgctgagagtctgggggtagggagtgactttactgctgaaaactagggctcatcttttcctccaaatctgtctcttgctttagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacacca

SEQ ID NO: 23601 - DNA, 576 bp, Homo sapiens
  ENST00000553980
ataatcgcccctcctcctcccccaaaagagagacagaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggagaagttaactccttggccctgacatctcgattcccatacacctccccccaccccatcttcccgagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggct

SEQ ID NO: 23602 - DNA, 609 bp, Homo sapiens
  ENST00000556944
agaaattgtaagggagaggctttgagataaaaccccaggaagaacttcccgagtctgtgcatgttggggcagaaagagcggcagagccaactccttccctgctccacagcacctgttgccttcattagcagcttttcctcctcttccctgcacttcccagaaccaaagaatgtgaagggggtccatggaggtgagtgaagctctggcttcaacctacaagtacctacaactgtatactccctctcctgcctacctctctctctctttgacctcccattattagaagttaactccttggccctgacatctcgattcccatacacctccccccaccccatcttcccgaggtgagtagcaccctgtgttcctagttcaggccccagcccaccttccctcgtgttgtccttctggccctcgaggcgacgcccttgcttcctttacagctctaccttcaccctttgctctacgcagatctttctccacagggctcacgtccccgcgccccgagcggccacttagcgccgtcgccgccggctttcgacggcgagctggatctgcagcgatactccaacgggccagccgtgagcgcagggtcgctcgggatgggag

SEQ ID NO: 23603 - DNA, 654 bp, Homo sapiens
  ENST00000555697
tgcagggtccgggatttggagtggatgggattatgaaaggtggacagaaaagaaaagtgcgatgaggcaaatgtgaagctgtatggggaggtgacaggaagagaggatatggatgcaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagagctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacg

SEQ ID NO: 23604 - DNA, 475 bp, Homo sapiens
  ENST00000556101
agatgccccatcatactgcaggctccaaggtttgaaacaaggggatgaatcctatacgctccacagcacctgttgccttcattagcagcttttcctcctcttccctgcacttcccagaaccaaagaatgtgaagggggtccatggaggtgagtgaagctctggcttcaacctacaagtacctacaactgtatactccctctcctgcctacctctctctctctttgacctcccattattagaagttaactccttggccctgacatctcgattcccatacacctccccccaccccatcttcccgaggtgagtagcaccctgtgttcctagttcaggccccagcccaccttccctcgtgttgtccttctggccctcgaggcgacgcccttgcttcctttacagctctaccttcaccctttgctctacgcagatctttctccacagggctcacgtccccgcgccccgagcggccactta

SEQ ID NO: 23605 - DNA, 2513 bp, Homo sapiens
  ENST00000624093
acaccggcgtgctcgcaagaggcgggaaagcgttagggagagacgcgggtcgcagggtccctccctctgcctgccctatctacccgcctgcccagcgagcctgtccatcttcagcgcccaggccctaggggaggggacgagaaaggccccgcgcttctgactcatcatctccaacccctttctcgcgcgcgctccaagtctcaggacttcggacctgggccctcctgcgagggggtgcggcgacagcatctgggaagccccagctctgccaagcgtcagctccgagccctcgccagtctctgaagctgccagcgcagggctggggacccagatccagctctctattgcagtggctgggggagcggcacgccagtgcaggaccgcccgcccggctcctccccgaacgcggggccagtggtcgcgtccgagaaagcgccaggctaggccccgacttccccgcctcgcgtcactcagcacatccaacagcgcccctaccgcggagagaaggctctttatttcctagccggtcacgggctagcggggcatcctgggacttgtagtctccgctacagtagaaaggagatggatcgaaaggggaactggggcactcctgaattggattcagggagttggcgtgtgcagggtccgggatttggagtggatgggattatgaaaggtggacagaaaagaaaagtgcgatgaggcaaatgtgaagctgtatggggaggtgacaggaagagaggatatggatgcaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagaggtgagaaaggagaaaccccagacagaaacaactgcttcctcctgcccaattttctatcctgtttcccatagtcctgccaatatttaggcagcttcctaatgctttcccactcttttaacctcaatcatttggattcccagtttcctcttacccaccattaggggagaaatgttcaaagccagagaaagccaatcagtttcattctaggacctcttcttttctctcctgccccattattttcccttaagtgccactgaccaggataggcagtggaaaaattagttggcagctagctattcgtgctttcttccctgcccccatacctcctgcagctcttgatagtgcagactctggctcctgcagcatcctggtttcctctggctcagcaagaatagggcgtgcactgagaccagcactccccctagggtgaaggcctcagcactgagttccagcaccagcaagccagcatgctgcaggtagacagggctgagaatgcagggaccccgcacctgtttgcccctgcccttttcccttcccacctcctcttgcctccttatcctcccaccttctccttcattgaccagtacctgggaggaggcagttggggcaggccccaaggctgtcttcatcacctcgaccaccaccactatgaaacccaagatcaagttgaaggtgttgaatatcatcatggcccgcacctgccagtgagccagctcagccctgcccagcctaggggagtcattccaacctcaatccccacttgcagcctagctgaagacaaaactcagcttctgcttctcagcctccaaacagggccataagccctcttaacttttttgctttcctcctcagtgattgaggccagtcagtggtgacagctgagagaatgagtcaacacttagccacttacttcctaggctgagggttgtaggtgtctgttttagggagtgggaggacagtgctgcgttttcttccctctcaccttccaaaggcggggtgctctgcgaagctccagagtgacagtcccagtgaggagaccctgaatggtgagaagggcaagtgttgagctctggtcccgttaggaaggggccctgggaccttccaccctcccttgtggtgggtcttactgaggctccaggcccaagaggcagcgctgtggccatgtgacaatcagagttcaggcaggcgactgagacagcaaggggcaccacaaccactgccagccatagctggctcacctgggggtaagggtagggtaattggggaggaactgtcagggattccctcccttctcgtaactcctacctctttagagatcaggaaatgggattgaatgcagggtggaggaaagcagtcaacccagagcaaggacgtgatcattaaaaattaagtatcattt

SEQ ID NO: 23606 - DNA, 820 bp, Homo sapiens
  ENST00000592725
atcctcagtgttctgtgtcctgtgcttatagaggcccgtcctctgtggccgtgtgacctgcaagtattgggagagccacagctaaaccccgggacccctggaagcctagaaatggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatac

SEQ ID NO: 23607 - DNA, 3519 bp, Homo sapiens
  ENST00000589717
ctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttatatgattgtcatacatgattgtaggtgatagaagtcatactgccaaaactcctgtaagtgtgaagaatgtggcaaaatattttattagtgcttataccttatttcacaggaaagctcttatccttgagaaaaattgtgcaaatacaaagaatatggaaaaaccattaatgcctactcacatcttactgaacagaagaaggttcatagttaataaagcattaaaagtgcaattactgtcaaaaaatctttcagaaaatagaagtctttaaagtgaagaatatttattctgaagacagccattacaaatataaagggggttgtagtgcctttacttgtgtcacagatcttagtgcacacatgtagtactagaggaaaaccctgaagcagttgctcaagctttgtttcagggaatcaagggaatttatattgagaatagtactgcaaatgtaatgaatggaaagacttttcttttccaaaaatgacagcttagaaaacaccagagggtttataccaaaatatatttttgcagatgcagtaaatatcaaaaaatatttaattcaaaattgattctatgtaaatatcagagaattttccatagaataattaaggcactgacacttcagacattacactaaatcagaatgttcagtataaaaactaatccacagctacagctgttagataaattatttctatataattttttaaaaagtggatttttgaagcactgtaattacattgaaagtatacttgttttcttgaaaaaatttttttgaaaagtgaataatgatataatacagctttcacattgctttatgctattttattcctattatattcacatgtgaaagcatgtgatcaattgttgctgcattagagatattagagattgttttttattagttgggcattatgtatgaccttttctataaaagagtaaggacattaaaatgtaagatgcatgatgaaaatataagtggagaggctctttgtagttaactgatattaagtaatgtgtaaggtgggggttcatgttctcatttctataatcctagccaatgacttaatgttgatgctttgaatgtcttttggatggtctaacctacattaacatgtatgcggaacatcttaaaactttttttcaaaaatcataatgaattattttattaataagcaaagataaaaaataa

SEQ ID NO: 23608 - DNA, 2268 bp, Homo sapiens
  ENST00000355650
gtgcttatagaggcccgtcctctgtggccgtgtgacctgcaagtattgggagagccacagctaaaccccgggacccctggaagcctagaaatgttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttatatgattgtcatacatgattgtaggtgatagaagtcatactgccaaaactcctgtaagtgtgaagaatgtggcaaaatattttattagtgcttataccttatttcacaggaaagctcttatccttgagaaaaattgtgcaaatacaaagaatatggaaaaacca

SEQ ID NO: 23609 - DNA, 297 bp, Homo sapiens
  ENST00000589668
ggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtgaggacaacttgaatatataattcataatataccctgaagattttatttctcttttttgtagaatgtttgttagtaatttattctt

SEQ ID NO: 23610 - DNA, 1208 bp, Homo sapiens
  ENST00000640599
ggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaaca

SEQ ID NO: 23611 - DNA, 3391 bp, Homo sapiens
  ENST00000443917
atcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactagctttcattttcccagtcccatgcagttgcgcagttggagggggcagaaaaccttgggtgcctgacagggcagacatcactgcagccacagtaaaggagacctacagagggcatggccctgctgaatgggagctggaagagggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcga

SEQ ID NO: 23612 - DNA, 3331 bp, Homo sapiens
  ENST00000598744
atcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggttgagaacagactgtgagcatgagggagcagctactgcagtagtgttgatggtgtctggtctagaggtgtggctgtggagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcga

SEQ ID NO: 23613 - DNA, 4202 bp, Homo sapiens
  ENST00000282286
acacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 23614 - DNA, 4313 bp, Homo sapiens
  ENST00000391705
tgaaggctgagttctagagatcgggtcggctttctacgcggctctcgtggaacctagcaaagaaagacagtgaagactgcaggaccttccttcgcgcttttgttacaatccacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 23615 - DNA, 1424 bp, Homo sapiens
  ENST00000513929
tcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggctggagtgcaatggcatgatctcagctcactggaacctctgcgtcctgggttgcagcgattctcctgcctcagcctcccaagtagctggaattataggcacccaccaccatgcctggctaatttttgtatttttagtagagacggggtttcatcatgttggccaggctggtctcaaactcctgatttcaagttatctgcccgcctcagcctcccaaagtcctgggattacaggtgtgagccaccatgccct

SEQ ID NO: 23616 - DNA, 5042 bp, Homo sapiens
  ENST00000253144
ggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcagg

SEQ ID NO: 23617 - DNA, 670 bp, Homo sapiens
  ENST00000502248
gtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatg

SEQ ID NO: 23618 - DNA, 1985 bp, Homo sapiens
  ENST00000511593
tgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaa

SEQ ID NO: 23619 - DNA, 578 bp, Homo sapiens
  ENST00000504033
tgacgttagtacttggaatgagagcgggactcacggggcataactgctacctgtacattgtttacaatgcagcaagcaagggacaccgaatagcagctccggcagcctgtgctagcggcctgcagagaattccaggtgacgctccagaggggctaggagaggatacccttctgaggacagccatggctcgcccggcatcaccccactcaagaggccagacggggtcccagctggggtgacacagctcctttcccagtcgggaaggggcgtctgcagggaccaggaagggcttagcttggggctgcccgctccggcaccgacctgggacgcgccctgaggcccctgcctgggaccgtcccggactacatttcccagagaccatccaggagtacgccgtgctgcatgctggaacacggggcttggggctctggtttcccccgacggccccgcgtcctcttctagcctcaccctctcccgaggccccagcgttgggggactaccgggccagcatccttcagaaaaagcatccccgaggaggaagacgaatcgttaaacatctgaaagggtcaggccagcat

SEQ ID NO: 23620 - DNA, 574 bp, Homo sapiens
  ENST00000514374
ttcccccgacggccccgcgtcctcttctagcctcaccctctcccgaggccccagcgttgggggactaccgggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgt

SEQ ID NO: 23621 - DNA, 2248 bp, Homo sapiens
  ENST00000411977
gcggccgctgggtgcgcgtgcgcatgcgcgctggcctccagggggtggcgggaccgagtgtgtgacgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactt

SEQ ID NO: 23622 - DNA, 2120 bp, Homo sapiens
  ENST00000511154
acgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactt

SEQ ID NO: 23623 - DNA, 461 bp, Homo sapiens
  ENST00000509069
gcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggccagcatccttcagaaaaagcatccccgaggaggaagacgaatcgttaaacatctgaaagggtcaggtgagtatccttttttttttatattaaatgatatgtgtttataagacttaagaccaaacattaaaggtagatgaccaagatttgagtcctgtttctgcctcttagctttttgagccttctgaagataggcttgtgaggagggtgaaatgcattaacacgcataaaacccatagacgcgcacccctgagtgggagtgcacagtgagtgctgctgttttgtgctaagtctggatgtctgtacat

SEQ ID NO: 23624 - DNA, 670 bp, Homo sapiens
  ENST00000509047
agtccgcgcaggtgagattggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaagg

SEQ ID NO: 23625 - DNA, 562 bp, Homo sapiens
  ENST00000509585
ggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttg

SEQ ID NO: 23626 - DNA, 350 bp, Homo sapiens
  ENST00000504940
gggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggtatggcaggtgttacccttccggttctgttttccccaggccagcatccttcagaaaaagcatccccgaggaggaagacgaatcgttaaacatctgaaagggtcaggtgagtatccttttttttttatattaaatgatatgtgtttataagacttaagaccaaacattaaaggtagatgac

SEQ ID NO: 23627 - DNA, 1890 bp, Homo sapiens
  ENST00000513999
aggtgtgtgtgacagtgcaacttgtagctccagcgtctctgctgcttcccctgccttcacctcctaaccaagcggtacctgcctgagaacaagggccgcggagggacgtgagcgcctgagcctcgcctggaaattcaccagcaagaaggcagaaacagccatgaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaa

SEQ ID NO: 23628 - DNA, 2130 bp, Homo sapiens
  ENST00000512387
gactgtgtgacgcacttgcgtgggagtgcgaggctgacgcggcggctctatctcccgtaactgtgacacgggtgcacgcaagcgtcattgggggtgatgggggccgtgctcggtgcgcttctgcaccggtgacgcaaccgctgtgtctccgccagtccgcgcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaa

SEQ ID NO: 23629 - DNA, 540 bp, Homo sapiens
  ENST00000511567
gtgcacgcaagcgtcattgggggtgatgggggccgtgctcggtgcgcttctgcaccggtgacgcaaccgctgtgtctccgccagtccgcgcaggccagcatccttcagaaaaagcatccccgaggaggaagacgaatcgttaaacatcttagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatc

SEQ ID NO: 23630 - DNA, 913 bp, Homo sapiens
  ENST00000514022
gtcattgggggtgatgggggccgtgctcggtgcgcttctgcaccggtgacgcaaccgctgtgtctccgccagtccgcgcaggtgagattggcgcccatggctccaaggggagacgggcacggagcttctagcggtgacgcacttgctggagagggtgtggggtgacgcagccgggctctccccataactagggctggggtgctcccgaggctttggggcgacggaacccgcacctgtgaacctcggcagtgcgtccccgggactctgttctgtgaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggc

SEQ ID NO: 23631 - DNA, 761 bp, Homo sapiens
  ENST00000505949
ggggcgacggaacccgcacctgtgaacctcggcagtgcgtccccgggactctgttctgtgaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatc

SEQ ID NO: 23632 - DNA, 739 bp, Homo sapiens
  ENST00000513265
ggggcgacggaacccgcacctgtgaacctcggcagtgcgtccccgggactctgttctgtgaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatcca

SEQ ID NO: 23633 - DNA, 573 bp, Homo sapiens
  ENST00000502616
ggtgatcgggccttctgggtgacgcaggtgtgtgtgacagcacaacctgtagttccagcgtctctgtgctgagatgggtgatcgggccttctgggtgacgcaggtgtgtgtgacaacacaacctgtagctccagcttctctgtgctgggatggatgatcgggccttctgggtgacgcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtga

SEQ ID NO: 23634 - DNA, 641 bp, Homo sapiens
  ENST00000504493
gctgagatgggtgatcgggccttctgggtgacgcaggtgtgtgtgacaacacaacctgtagctccagcttctctgtgctgggatggatgatcgggccttctgggtgacgcaggtgtgtgtgacagcacaacctgtagctccagcgtctctgctgcttcccctgccttcacctcctaaccaagcggtacctgcctgagaacaagggccgcggaaggacgggagtgcctgagccctgccaggaaattcaccaacaagaaggcagaaacagccatgaggccagcatccttcagaaaaagcatccccgaggaggaagacgaatcgttaaacatcttaggtcagctttaccagtgaggaaaccgacactgtgagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataaggg

SEQ ID NO: 23635 - DNA, 688 bp, Homo sapiens
  ENST00000505426
agcggtacctgcctgagaacaagggccgcggaaggacgggagtgcctgagccctgccaggaaattcaccaacaagaaggcagaaacagccatgaggtgacgctttcagagctagaagtgctctccactcagggcgcctgagtgacaggagacggtggcctcaggagtagaattcctcctgtagagggacacgtccctgatgtgggagacagggagaggggcagctccacgcttcatcatctcagttaccacagcgtgctcttcaggaatctcccagaaactccatctcggggcctcgtatttctcattggttttattaggtatggcaggtgttacccttctggttctgttttccccaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaa

SEQ ID NO: 23636 - DNA, 3817 bp, Homo sapiens
  ENST00000449416
gttttaccagtgaggaaactttaccacactgtgaactctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcagg

SEQ ID NO: 23637 - DNA, 1851 bp, Homo sapiens
  ENST00000587539
atggcccgggtgccattgacattcagcgatgttgccatagacttctctcaggaggagtgggaatatttaaactcggatcagagggatttgtacagagatgtgatgttggagaattatactaacttggtctcattggactttaatttcacaactgaaagcaacaagttatcttcagaaaaaagaaattatgaagtaaatgcgtaccatcaggagacatggaaaagaaataaaaccttcaaccttatgaggtttattttcagaactgacccacagtacacaattgaatttgggagacaacagagacctaaagtgggatgttttagtcaaatgatattcaaaaaacataaatcccttcctctacataagagaaataacacaagagagaaatcatatgagtgtaaggaatataagaagggctttagaaaatatttgcaccttactgaacatctgagagaccatactggtgtgataccctatgaatgtaatgaatgtggaaaagcatttgtagttttccagcattttattagacatcgaaaaatccacactgatttgaaaccctatgaatgcaatggatgtgagaaggcctttaggttttattcacagcttattcagcatcagataattcatactggtatgaaaccctatgaatgtaagcaatgcgggaaggcttttagacgtcattctcaccttacagaacatcagaaaattcatgttggcttgaaaccctttgaatgtaaggaatgtggggaaacgtttagattatatcgacatatgtgtctgcatcagaaaattcatcatggtgtgaaaccctacaaatgtaaagaatgtggaaaggcttttggtcatcgttcaagtctttaccaacataagaaaattcattctggtgagaaaccatataaatgtgaacaatgtgaaaaggcctttgttcgcagctatctacttgttgaacatcaaagaagtcatactggtgagaaacctcatgaatgcatggaatgtggaaaggcttttggtaagggctcaagccttcttaaacataagagaattcatagtagtgagaaactctatgattgtaaggattgtggaaaggccttttgtagaggctctcaacttacacagcatcagagaattcatactggtgagaagccacatgaatgtaaagaatgtgggaagacttttaagcttcattcatatcttattcaacatcagataattcatactgatttgaagccatatgaatgtaagcaatgtgggaaagccttcagtcgtgttggagaccttaagacacatcaatcaattcatgctggggagaaaccctatgaatgtaaggaatgtggaaaaacctttagacttaattctcaactaatttatcatcagacaattcatactggtttgaaaccctatgtatgtaaagaatgtaagaaggcctttcgttctatctcaggtctttctcaacataagagaattcatactggtgaaaaaccctatgaatgtaaagaatgtgataaggcctttaatcgcagtgatcgacttactcaacatgagacaattcatactggtgtgaaaccacagaaatgcaaagaatgtggtaaggcctttagtcattgctatcaacttagtcaacatcaaagatttcaccatggtgagagactcttaatgtaatgagagggaaagcctttagccatggcacatttttactgttgtcactattatgatgctatagtgaagattaaactagttaatatagaatataaatacttggaaaggcatctggcacatcgtatttgcttactaaatacattatttttatgataattgttagaattactaaaaataaatcttatagaaggaaga

SEQ ID NO: 23638 - DNA, 631 bp, Homo sapiens
  ENST00000588094
gattcatggaggcgtgaaggatcccagcaagaaaacacagacttgatcttgagacgagatttttgaaattggttgcggcctcaaggcaggctctgagaagactcgataaagagttctcaggaataggcatccctcctggatatttcccccttggaagcgccgaggagccagctctatgtttgtaaccatagcatttctaaagctccagccccaggaacctgctgtgaattagagacagattccaccctaggcatcactgatcttggcctctcttgtattgggaaggtcaacactgttccagtttctctcctactcccatctggttgtgctcggtgaagtaggtgagcagtgctacccttctgttaaaaaaaaaaaaaaaaaaaagatcctgaaagaggaaagaatttttgctacacatctgaaagctaaagtccaggtgatgccttgattacctagctttggcttctctgaactctgcttctctgatagaggaaacctgaagagaactagcatttctgaaaccatggcccgggtgatccgcctgcctcaccctccgaaagtgctgggattacaggggtgagccatcgcacctggcctctgctgggattttgactgagattttgttgaatct

SEQ ID NO: 23639 - DNA, 1844 bp, Homo sapiens
  ENST00000324394
tttcaggtgccattgacattcagcgatgttgccatagacttctctcaggaggagtgggaatatttaaactcggatcagagggatttgtacagagatgtgatgttggagaattatactaacttggtctcattggactttaatttcacaactgaaagcaacaagttatcttcagaaaaaagaaattatgaagtaaatgcgtaccatcaggagacatggaaaagaaataaaaccttcaaccttatgaggtttattttcagaactgacccacagtacacaattgaatttgggagacaacagagacctaaagtgggatgttttagtcaaatgatattcaaaaaacataaatcccttcctctacataagagaaataacacaagagagaaatcatatgagtgtaaggaatataagaagggctttagaaaatatttgcaccttactgaacatctgagagaccatactggtgtgataccctatgaatgtaatgaatgtggaaaagcatttgtagttttccagcattttattagacatcgaaaaatccacactgatttgaaaccctatgaatgcaatggatgtgagaaggcctttaggttttattcacagcttattcagcatcagataattcatactggtatgaaaccctatgaatgtaagcaatgcgggaaggcttttagacgtcattctcaccttacagaacatcagaaaattcatgttggcttgaaaccctttgaatgtaaggaatgtggggaaacgtttagattatatcgacatatgtgtctgcatcagaaaattcatcatggtgtgaaaccctacaaatgtaaagaatgtggaaaggcttttggtcatcgttcaagtctttaccaacataagaaaattcattctggtgagaaaccatataaatgtgaacaatgtgaaaaggcctttgttcgcagctatctacttgttgaacatcaaagaagtcatactggtgagaaacctcatgaatgcatggaatgtggaaaggcttttggtaagggctcaagccttcttaaacataagagaattcatagtagtgagaaactctatgattgtaaggattgtggaaaggccttttgtagaggctctcaacttacacagcatcagagaattcatactggtgagaagccacatgaatgtaaagaatgtgggaagacttttaagcttcattcatatcttattcaacatcagataattcatactgatttgaagccatatgaatgtaagcaatgtgggaaagccttcagtcgtgttggagaccttaagacacatcaatcaattcatgctggggagaaaccctatgaatgtaaggaatgtggaaaaacctttagacttaattctcaactaatttatcatcagacaattcatactggtttgaaaccctatgtatgtaaagaatgtaagaaggcctttcgttctatctcaggtctttctcaacataagagaattcatactggtgaaaaaccctatgaatgtaaagaatgtgataaggcctttaatcgcagtgatcgacttactcaacatgagacaattcatactggtgtgaaaccacagaaatgcaaagaatgtggtaaggcctttagtcattgctatcaacttagtcaacatcaaagatttcaccatggtgagagactcttaatgtaatgagagggaaagcctttagccatggcacatttttactgttgtcactattatgatgctatagtgaagattaaactagttaatatagaatataaatacttggaaaggcatctggcacatcgtatttgcttactaaatacattatttttatgataattgttagaattactaaaaataaatcttatagaagg

SEQ ID NO: 23640 - DNA, 9243 bp, Homo sapiens
  ENST00000462139
agaattccttctcagtacagagaggccgtcattctttctgtgcgtgtaggatcatcccttgtgaggtttctgtagcttacttaatccgctgtcttcttgatgtgtgtcaaggttttcagtatttattagatcaatgcttcagtgaagcagcttttgtagactacgttgcacatgtgcaacataaacttgagaaatccctgcacggaagggtgggcatgttggtaacgtgcaacaacataaactttaggaatctctgcattgaggggcgagcacgctggtgacctctggacattgcccagcagcgcaccataggagtggtggatgtgcagcctccccagcactgaggaggaagacctgtttctccacatccttggccacccagccaggtagctgccatgtggattttgccaaacaagatagggatgaggtggatccaagagcagaaataacaaagcagtgtgtccactggcgcctggacctggggtagtcggtctcctttctgtctcttctatctgcatgtgttgctttgggctcttccctcagccccagcttccacaccacccccctcccctagtgctatggtctgaatgtttttgtgttcccctccccacagctttgacatgttgaaatgctagcccccaagctgctggcattaagaggtggggcactggggagatgatcaggttataagggcaaatccatcataaatggattagtgcccttctaaaagaggcctcagagagcagccttgccccttccaccatgtgagaacacaatgaaatgatgaccatctatggagcaaggaactgggccctcaccagaacccaactatgctggtatcagctggggacttcctagcctccagaactgtaagacatacatttatgttgtttatgagtccccagtctgcggtattttgttagagcagcccaaatggattaagacagaaaattggcaccgaacattttgggtgctactctaacaaatacaacgtggaagaagcttgggaaccgggtaatgggtagaggctagaagagttttgaagtgcaggctagaaaaagcctgtgttgccatgaacagacaattttttctttttctttttcttttttttttttttttgagatggagtcctgctctgtcacccaggcaggagtgcagtggtgcgatctctgctcactgcaacctcagcctcctgagtagcggagattacagatgtgcaccaccacacctggctaatttttgtatttttagtagagacagggttttgctattttggctagctaggctggtctggaactcctgacctcaggtgatctgccagcctcagcctcccagagtgctgggattacaagtgtgagccaccgtgcccagcccatgaacagactattacgggtgatttctagtgaggctccaaaagaaaagaggagatttgaaatcctcaaccagaatgttggtaaaaatgtgaacagtaaagctattcttatgaggtcccagatggaaatgagaaacgtgtggtgggcaatggaggaaaggccatccttcttatagtggcaaatcacttggctgaactgtgcttatgtattagtgttttgtggaaggtagaacttacgggccactgcaattggatatttggctgcagaaatatctaagcaaggttttgaaggtgcagcttgtgaaatgtgaaaagagagaagtgatttaaagatgggattgttacttaaaagggaagcagaacttaaagatcgggaatatttgtcagcctatgttggtaagagtgagccagcctgtttaggagagaagataaaggttttgccattgaaactgaggctaggagctagtccaagaaaatggaaaaatgaccccaaaggcaattcagaaatcatcagggctcttctgcccatcacaggcccagagcgcaagacccgcagcaagcaggggaccacagcagagagccccgcttcagtcacccctgaagccctagatggtggggccatcagcgaagttccagcccaagagagccttgggcttctgaaagagacagagctgccacagaggtggggccactgcagagaaccacctcaagggcaggccctcaccaggggctgccatggggcgggaccacccagggccttggggactcaactcctgcccagtgaagctgccacctgtgggtttggaaggcggggtcacctcccaacacagtgggcctggggagcacagcatcaagacaaaaaggattattctgcagattattctcaagccgtaaaccataatgtgctgtgacccataggttcaggacttgctggggacctgttactccttttctttttttctgtttcccttttttggaactggaatgtttatcctgtgcccgtctcaccactatatatgtgtgtgtgtgtgtgtgtgtgtgtgtgtgtgtctctgtgtgtgtgttttgtttttttttttttaagactgagtctcaccctgttgcccagggtggagtgcagtggcatgatctcagctcactgcagactccgcctgccgggttcaaatgattctcctgcctcagcctcccaagtagctgggattataggtgctcaccaccacgcctggctgctttttgtatttttggtagagatgaggtttaaccgtattggccaggctggtctcaaactcctgacctcaggtaatctgcctgcctcggcctcccaaggtgctgggattacaggtgtgagccactgcgccggcctcaccactatttggaaggcacataacttgtttcatttcacaggttcacagctggagagaattttgtgtcaggtagaattgtgccttgagtttcaaccgtaactgatttagatgatatttaaatgagatgttggactccggacttttgagttgatgctggaatgaattaagactttgagggttattgggatagaatgaatttgtttggcatgtgaaaaggatatgaatttgggggaaccaggggcagaatgctatggtttcagtgtttatatctccccaaaatttgtgttgaaattgtaatccccaagatgatggtattaggaagtggagacttttggggagatgatctggtaacaagggcaaagtcctcatgagtgggattagtccctcctaaaagaggccccagagaactcccttgccctctccatcatgtaaggacacagaagacacctgtcttttgaccaagaagtgggccctcaccaggcacccagcctgctggcaccttgatcttggacgtccagcctccagaactgtgaggaacagatttctgttgtatagaaactgcccgtcctacagcgttgtgttgtcacagcctcagtggactaagactgagacacctagctcgtcccggactgaggcatccctgttctcctgtgctttcagagtcgggtttctccattcaaggacatgattttatgcttctctgaagaggattggtcccttctagatcctgcccagactggcttctatggagagttcatcattggggaggattacggggtctcaatgcctccaagtaagacttaacttccccccacacctcaagaccagggaactgggcaggggagttctcacttggagtaagagtcaacttcgtcccataggatcagggaagcggggcctgcatcagatctctctgttcacccccaacctggacaggaggtcatttgcacacagcggccctacaggcagtgtgtccgattgaccatcacctgctgtctcgccacatcaggcttatcagaaccaaatagaacatgtgctgtatgtccatttctcttccatcgttcttaccgttttgtccctttatgtctgctttacacccgaaagcctcagagagacccccaagcccatagctctccctgcgtgtgctgcccccactgcccctgcactgccagctctggccttttcacttctcgcccctgatggtgccatgcccgctgggcatccctccgccttctctcttctggaccagccctggttgctgcaggatcagattactaataaacatgtaccctgcctttttctttgaacagacgacctagctgcccagccagatctctcccagggagaggagaatgagccacgcgttccagagttgcaggatctccagggcaaagaagtgccccaggtctcctacttgggtgagtaatgattccagaactgagtggacagagtagggggaagggttgctggcagccggaggtgagcccactctctggcttctctctgcggcccctaattgccttcttcatttccccagactctatgtgggtcttgcatgtcttgccttgtccctgacttttcatagaaagaatggaggatcttaattttgccaggcattggaattgtactcccttggccaaggactgggaaataataggaatgtctttctcctctgcctgtaagtaacatctggtttgtgctgacaatgcagcagcccctccaggagtgaagtcagatactcatgacaagcctagttgcagagggagtgtctcctaactgggcaccgagcgcagccctttgaggtgcctcacctgtctagtcttcccatctgcctggtacaggggtgctgtgaggacactggggtgtggggaggtgctggggctcagcagcagcagtttccagccctccttcaggctgtgtcgccagcacttgcacccatgatctccatgccatggtgcttcgaagcatctgctccttcaggaggaaatagctttgtacagaatcatcagcagctccacaccttcttcccctttgggacctagagctggcatgaagcagacaaggttttgacacaccatccccacctggaacaagcgttcagagacttggtgtggtgcagtagctcctgtaccatctctaccctgtaggctctgcacaagctgtttgtgcaggatgtgcggagtgtgcaggagcctgtggtgatgactatagaaaacccaccacagaaagtgggaataaatatggggctgggggaagtgcttgtctctggccatagagtgggtggagtagaacccggatctacgtcgattctgtctagcgtcagagctcatgtttgtggagttggcccattttgccttcaggttcattcactcagcagacacttattgagtggccaccccctgccagtccccaggacggagcccagggccgcccccagatcgtagcctggcatctattcggatagcaccctcccaggtagtgctgtaggtgcaaaacaaatcaatttttccatttcctcctctggaaagactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaatat

SEQ ID NO: 23641 - DNA, 5336 bp, Homo sapiens
  ENST00000294753
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaacggttgaggcttttactttctaaatagtttgtctcttgtatcaacatagctggaaaagggagaaatccgatttttaaggccaagggaggggaaaattccaagtagaagccaggctctctgtacacgtttaccccacctacctgtgtgctcctacctgtgctgaggattctctctgtagctctaaggtcttgggaaggttattcaccttcctgcttcagacgtctgactcaagagaagaacactgttctacttaccagagtgtttttctgtgtaaaaccacatcatgaaggagaaagcgacaaagggaatgtgaggggctggaagccacagggaggctgtctcttgagtccccaccactgatccagagccaaccaaggcacctcaggaaatggaaggccacattgcctctggatttggaaatcctcctgggtaatgtaactgaaacccaggttgatgccatgcagcaggagcagcagggggaacgtgctctcaggagaggtcggccaaccctccagcccaacacccttcaccacagtggtggaggaggctgcacccaggagatctttgtctcccttttggccactgatacctttggccttatctgacaacagctacccctcgatccttccctcccaccccaggggctgggcagctggctggagctttgtgtccaccttgctctggaggttgagacccccatctgagcaacatcctctctctttgttcctctgatcccttggcatcgtcacaaacccacaggtgcataataaaaacttgctgagtcaatat

SEQ ID NO: 23642 - DNA, 3857 bp, Homo sapiens
  ENST00000461277
caggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagaatttttcaatttaataatcatcgcagcaatggttatattttagaaatgttaggaagtggagggaagaaagcacagataatttcagtcctgtcacagatctacgtgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaacactggctggcttagaacaacaggagtgtattccctgacagttctgggaggtgcacgtccaagatcagggtgtcctcagagttggtgccttccgagagctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagtaagccgagatcatgccactgcacaagctaggtgacagaatgagactctgtctcaaaaataattaaaaagcctctgccccaaactcgttaaaagattttataaccacaactgctgtttctgtgtagatgcatctgcatgcccaggagcagtaaatgcaataaaatcatttggttatactttgaacacaaaataaa

SEQ ID NO: 23643 - DNA, 1007 bp, Homo sapiens
  ENST00000478225
gcgggctcccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccaggtatgca

SEQ ID NO: 23644 - DNA, 907 bp, Homo sapiens
  ENST00000477903
cgggctcccgcggcggccaggcctgcgccgcccgccaacagggacgcgccgcggcggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcc

SEQ ID NO: 23645 - DNA, 589 bp, Homo sapiens
  ENST00000597363
atttggtcacggagaggtgaggttttcctcttagtccaattccaagaagtcagcaggggttggccttaggttccctgtctccagactctattctcctgcctcatttggacccctacaatctaattgtgaatgtaaaagggatctacggaagtttgaacttgagagtgatgacctagggtatctggcagaagaaatgcctaaataacaaagcattcaagatatggcctggctgcttgtaaccacctatgctaagatgtgggagcaaagaaatgacttaaagctggaacttatatgtaaaagtgagttcttatgagatctggacatttaaacgtgtgtaccatctccctcctcactctcttgctcctgctttcaccatgtgatgtgcctgctcccattttgccttccaccatgattggaaacttcctgaggcctgctcaaaagcagatgccactatgcttcccgtacagcctgcagaactggatcctgaaaaggagggaacaattgttgtagcaggtctaaaagttcaggtccaggaaatggaaacattgctttgcttttcctgaattgtccagtgacctatcccaggcct

SEQ ID NO: 23646 - DNA, 626 bp, Homo sapiens
  ENST00000599504
acatttcccagaagccccttgggcagtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccagccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtg

SEQ ID NO: 23647 - DNA, 714 bp, Homo sapiens
  ENST00000596894
acatttcccagaagccccttgggcagtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcagagtctcgttctgttgcccaggctggagtgcagtgatgtgatcttggcttactgcaacctccatctcccaggaaaattgcatgaacctaagtggcagaggttgcagtgagctgagatcgcaccactgcactctagcttgggcaacagagcaagactctgtctcttaaataaataaataaatagattaccagaaaaatgaaaagaaaaaaacagacatacaaaataaaagccccagttttttattatggtatttaactgagttaactctgtcagattgctgcaaacatttctaaatacttgctcttggtatctataacttttgcagagaccagaagcaaacaatttgtgggccagtgtcaacacatggaccacactttatatagcactgtaacggaaaatgattctgttaatgtaatgaacatgggaaagaccagccttggcctatctttatga

SEQ ID NO: 23648 - DNA, 490 bp, Homo sapiens
  ENST00000593687
atttcccagaagccccttgggcagtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcagagtctcgttctgttgcccaggctggagtgcagtgatgtgatcttggcttactgcaacctccatctcccaggttcaagaaattctcctgcctcagcctcccgagtagctgggattacaggcgcctgctaccacgcccagctaattttttgtatttttaatagagatggggtttcgccatgttggccaagctggtctcaaactcctgacctcaggtgatccacccacctcgg

SEQ ID NO: 23649 - DNA, 561 bp, Homo sapiens
  ENST00000601138
agtgttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccagccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagagtctcgctctgtcacccaggctggagtgcagtggcacaatctcggctcactgcaacctccacctcccgggttcaagcaattcttctgcctcagcctc

SEQ ID NO: 23650 - DNA, 3426 bp, Homo sapiens
  ENST00000600094
gttgcctggaccccaagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcagccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtcctatgcataatgtaaagagaatacgatggcctttagaaaatgccctttagcagagaatttgtaatttaagaaattttctgtttgttacggaacatgtgggaatcccttttacttcatgctcacaatttatcagaaattatttcgtatgttaaagagtcgaaagactatagcatcactcagtccctgttagactttagaagattgatactgatgcactgcatcccaaaccatcaagggccttttcccctacaaactgttgttgaacagtgcttctctaaaatgcaataataatgggccaggtgaagtggctcacacctgtaatcccagcactgtggaaagacaggagttcgaaaccagcctgggcaacatagtgagaccctgcctcatggctttagtgagccatgattgtgccactgcactccagcttggtgacagagtgagatcctgtctctaaataaataaataaaatgcgggccaggcacagtggctcacacctgtaatcccagcactatgggaggcccaggtgagcagatcacctgaggtcaggagttcaagaccagcctggccaacatggtgaaaccccttctctactaaaatacacaaattagctaggcattgtggggggtgcctgtaatcccagctactcaggaggctgaggcaggaaaattgcatgaacctaagtggcagaggttgcagtgagctgagatcgcaccactgcactctagcttgggcaacagagcaagactctgtctcttaaataaataaataaatagattacc

SEQ ID NO: 23651 - DNA, 7987 bp, Homo sapiens
  ENST00000347077
caagggccctttacattgcgttcttaacggttcagtcaccttaaccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatgccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagggacaaggaattggttcacagatttggaatacaagtatattaccaagaatttgctttcagaaaagaatgtttgcaaaatctatttatctcaattgcagacaggggaaaaaagtaaaaacaccatccatgaggacaccattttcagaaatggtttgcagtgtaaacatgaatttgagagacaagagagacatcagatgggatgcgttagtcaaatgctaatccaaaaacaaatatctcatcctctacatccaaaaattcatgctagagagaaatcatatgaatgtaaggaatgtagaaaggcctttagacaacagtcataccttattcaacatctgagaattcacactggtgagagaccctataaatgtatggaatgtggaaaggccttttgtcgagtgggagaccttagagtacatcacacaatccatgctggggagagaccctatgaatgtaaagaatgtgggaaggcctttagacttcattatcaccttactgaacatcagagaatacattctggtgtgaaaccctacgagtgtaaggaatgtgggaaagcctttagtcgtgttagagaccttagagtacatcagacaattcatgctggagagagaccttatgaatgtaaagaatgtgggaaggcctttagacttcattatcaactaactgaacatcaaagaattcatactggtgagaggccttatgaatgtaaggtttgtggcaagacctttagggtacaacgacatattagtcaacatcagaaaattcatactggtgtcaaaccctataaatgtaatgaatgtgggaaggcctttagtcatggctcataccttgttcaacatcagaaaattcatactggtgaaaaaccctacgaatgtaaagaatgtggtaagtcctttagttttcatgcagaacttgctcgacatcgtagaattcatactggtgagaaaccctatgaatgtagagaatgtggaaaagcctttcgtcttcaaacggaacttactcggcatcatagaactcatactggtgagaaaccctatgaatgtaaggaatgtgggaaggcctttatttgtggttatcaacttactttacatctgagaactcacaccggtgagattccctatgaatgtaaggaatgtggaaaaaccttcagtagtcgctatcatctcactcaacactacagaattcatactggtgagaaaccctacatatgtaacgaatgtggaaaagcctttcgtcttcaaggagaacttacccgacatcacagaattcatacatgtgagaaaccctatgaatgtaaggaatgtgggaaggcttttattcatagcaatcaatttatttcacaccagcgaattcacaccagtgagagcacctacatatgtaaagaatgtgggaagatttttagtcgtcgctataatcttactcaacattttaaaattcatactggtgaaaaaccctacatatgtaatgaatgtgggaaagcctttcgatttcaaacagaacttactcagcatcacagaattcatactggtgaaaaaccctataaatgtacagaatgtgggaaggcctttattcgtagcactcatctcacgcaacatcacagaattcatactggtgagaaaccctacgaatgtacggaatgtgggaagacgtttagtcggcactatcatcttactcaacatcacagaggccatactggtgagaagccctacatatgtaatgaatgtgggaatgcttttatttgcagttatcgacttacattacatcaaagaattcacactggtgagcttccatatgaatgtaaggaatgtggaaagacctttagtcgtcggtatcatcttactcaacattttagacttcatactggtgagaaaccttatagctgtaaagaatgtgggaatgcctttcgtcttcaagcagaacttactcgacatcacatagttcacacgggtgagaaaccctataaatgtaaagaatgtgggaaagccttcagtgttaattcagaacttactcgacatcacagaattcatactggtgaaaaaccctatcaatgtaaagaatgtggaaaagcctttattcgtagtgatcaacttactttacatcagagaaatcatattagtgaggaagtcctatgcataatgtaaagagaatacgatggcctttagaaaatgccctttagcagagaatttgtaatttaagaaattttctgtttgttacggaacatgtgggaatcccttttacttcatgctcacaatttatcagaaattatttcgtatgttaaagagtcgaaagactatagcatcactcagtccctgttagactttagaagattgatactgatgcactgcatcccaaaccatcaagggccttttcccctacaaactgttgttgaacagtgcttctctaaaatgcaataataatgggccaggtgaagtggctcacacctgtaatcccagcactgtggaaagacaggagttcgaaaccagcctgggcaacatagtgagaccctgcctcatggctttagtgagccatgattgtgccactgcactccagcttggtgacagagtgagatcctgtctctaaataaataaataaaatgcgggccaggcacagtggctcacacctgtaatcccagcactatgggaggcccaggtgagcagatcacctgaggtcaggagttcaagaccagcctggccaacatggtgaaaccccttctctactaaaatacacaaattagctaggcattgtggggggtgcctgtaatcccagctactcaggaggctgaggcaggaaaattgcatgaacctaagtggcagaggttgcagtgagctgagatcgcaccactgcactctagcttgggcaacagagcaagactctgtctcttaaataaataaataaatagattaccagaaaaatgaaaagaaaaaaacagacatacaaaataaaagccccagttttttattatggtatttaactgagttaactctgtcagattgctgcaaacatttctaaatacttgctcttggtatctataacttttgcagagaccagaagcaaacaatttgtgggccagtgtcaacacatggaccacactttatatagcactgtaacggaaaatgattctgttaatgtaatgaacatgggaaagaccagccttggcctatctttatgatatatataaataatataattctcataattccacctctgcctatgtggtgtttggcaaaacatgcccctgtgccttggtttttaaaatggtaataacagtaccacctaatagtatttttgtgaggatgaaatgctaataaaagataaaacctttaaaagagtatttggcacacagcattttatcaataaatattgctttatttttttcattggggatacatttagtacattcatgtgagaggaaggccctgtgggtgtaagaaatttgtaaaaactgtccattacctttcactccttatttagattggaataattaactggagataatatccagtaaaatagattaaacttccatttataaagtcagaacctatctctgaaaattaatgtgagaaagaaatctctagatttgatgggtgtgaagattatgagagtaaagttttgaagactcagggatagctgtaatgcttttttctttttataacccaaaaagcaggtatgtcagtcgctttttctgcccacaatgataaattaaaaacagccactatccatttggaaaacttaaaagaataatgaacagttatgttctatctagattcagcaattgttaatatgttgtcacatttggtttgcttatacataatatttacatattttgctgtagtatttgagtataaattgcagatactataacacatcacatctaagaataaaggctgcctcctacttaattgctatataacaattgtccaacctgtctgtgccccagggcagctttgaatgcagtccaacagaaatttgtaagctgtcttaaaacatgagattttttttgtgattttttttaagctcatccgccattgttagcacattttatgtgtagcccaagataattcttcttccagtgtaacccagggaagccaaaagatttgacccccagtaacttcacacctaaggagattagcaataattccataatctgtaatattcagtctgtgttcatattctcagttgtgttcattcttttcatttgtgtaaacaatgcttttcataggttatttttaaattcaggaaccaaattcatgaattacatttgtgcattgttcgtctcttttaaagtaagaatggcccttccccccacaactttattgcaacattgactttttttttttttttttttttttttttttgagatggagtctctgtcgcccaggctggagtgcagtggtgcgatcttggctcactgcaagctccgcctcccgggttcaggcaattctgcctcagcctccccagtagctgggactacaggcgccttcaaccatgcccggctaattttttgtatttttagtagagacggggtttcaccatgttagccaggacggtctcgatctcctgacctggtgatctgcccgcctcagcctcccaaagtgctgggattacaggcatgagccaccgcacccggccttcccaaagtatttttaaatgtgcttttttatccccagtatttcccattaactggaatttgggattagagacccaattagggacagattaaatattttggcaagaatacttaatgggagaaattttgtatttcaatttgtaacccattaggtggcatacaatgtcattataccactatggtatccttagttcattcacttggtgtagcagaacatacattccaaagatggccacaccaatatatcccattctgcatgttcatcttacaatgtgataccaacactccccaagaggtagagctcatggtccttccttttgaatctggccaggtgggcctgtgtttatggcaggaataacactgtgatttccacgactaagtcataaaaggcaatacagcttctgcctgacccacttgggatgaagcccagccaccatgctatgaagatgccaagtaatcacatagaaaagctaagtaaagctgtcctgattacagctgtaattgaggtaacagccgggatccagcaccaagtgtatgagggtatgagccttcagatgattctaacccttagccttcaggctatcctagctggtgctaagtggagcagagaaaagctttcccccatgagcctgcccaaattgcagatttacgtttaaaatatggcctgttttaagccactaagttttggagtagtttgccacacagcgataggtaactgaaatacttgcttcatatggtaatcaccaggtttctctgttgtagagctaaatatttcttttaatttagtaaacgatctgtagagtagtactttggcatttcggaaatttaaaatctccaataatataatgacactagatcaaaaagaaaatgaaaccataaaggacaatttagaaatgaatggtaagatcagaatttgtgaatgtggccaaacctgtgctcagtgaaaaatcagtaacctgttaatatattcaggaaacaaatattgagggccagcactttgtttctcctgctcaccactctactcccagtgacttaatactgtctctttaacatagtaatcacttataaaactgttaaaagaatgaagaagcattaaactcaagaaactaagggaaaaataagtcaatataagaaagaagggaggatcattaaaaggagttaatgaatttgaaaataaaatagacttattaaggctttgtgaaaaaatattaatacttgattttagtatagctaatcaaaggaaaaagataattacagcattgtgaatgagaattggatgtaagtacagatggaggagatattttttgttttattgaaaatttcaaggaggaagtaatatcaaaatttcactagctctttctacactgatattataatcctgataatacaacagatgaggatagttcttaaaaggcaaaaatgtaggtgagtcattacgaagaaagcagaaattctaaaccatcagcacattcattcaaaaacctagtaaagcaattaagcaaaataatttgtttacttggactgtccagggatagatctgttctagttttccaaattaatgatgggaaaggaagagctgatccagtccaagtatcttcaagatccatgttctcagtttttcttagctttaaatggccaaattgtggcttagattggatatgataatttcctcaatgcttaacactgagcacaatttttcacatatttgaaatcaaggtgtatcttacaatttatggcatctgacaatacttccaaccaggtggcagtcatcaagcagttttgtgaaaagccttcccggtaagaatacaaaagcatctgcaccaaaatatatagatttaatggcatgtaggggtttgcgtgaatatatacagttgaaattcaattcttccttaaaaataattgtaactcatttctttaagactaccatactaccactttcctcaacttggactaatgtccattgtcaaccaaaatgtctgtgatctcatggatccattatgatttgcaactccaggtccattttatgcaaataagacagccataatatatcattgtacaagtcatttactatctaattatatcattgctcaacatttgcaaattatttttacaaataacaataattggatgtaacaaaaagcagagtattttgagacgtatattaatgcaaaatattgttaatgtatcagtggattgttcctccaaagtaccagtgccttaacacaacatatctaaaagaacatctctgggaacagtagtacttaatggcaacttgagaattggtttgtgggcacacagccttgtgaagttttgaatactaaatcccttttttaaaaaagtgcttattatcaggctatcaatcaaaagatttgagtctttcagtaaagaaaatttgcttaattttatctagtgcatgataaactttactaaggaagtctcattcagaatatctaatattttggatgtgagcccacactggaaatgccataaccaaaaaagagtgaccctaaagatagaatattcagatctaatggcagatgcttagctatgctgggaaaggaagtgaattgtatattgctctgctgctcacatattcctctgcaataaattgctggcccagtttagtttttatatactcactactatactaatgaggatggctcaattttttatttgaacgtactataatgaatttaaactttcattggtatttatgttttaacaggttttcactatttcaaatatacttcaataaatatccttgtctgtgatca

SEQ ID NO: 23652 - DNA, 396 bp, Homo sapiens
  ENST00000602253
ccgttattattcacttgcgggcgagaagtccgagctagggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatggtagagaaatgcatatcctggagtctaaagttaaaactttgttttattgagattaatgtttaggtagaatcacatcatccatcttctccaatcttctccaaagacctcagttttaaaatatgacaggattagagatgacc

SEQ ID NO: 23653 - DNA, 542 bp, Homo sapiens
  ENST00000595225
ctggcgtgtcgtgcccgcagggagcctcaggcctggatcctgaaaaggagggaacaattgttgtagcaggtctaaaagttcaggtccaggaaatggaaacattgctttgcttttcctgaattgtccagtgacctatcccaggccttcctttccagtgaacaatggaccatgcaggtggaccctcctcttcacgggcctccaaatgactttctcatttttcaaatcattcctctgcactcactttctataatgccccggtttctctggattctgtgcttctccatggaggaaactcaaggagaactgacaagttcttgtggttctaaaaccatggccaatgtatctttggcatttagggatgtgtccatagacctctcccaagaggagtgggagtgcctggacgctgtgcagagggacttgtacaaggatgtgatgttggagaactacagcaacctggtctcactgggatataccattcctaagccagatgtgattactttattggagcaagagaaagagccctggatagtaatgagggaagg

SEQ ID NO: 23654 - DNA, 589 bp, Homo sapiens; identical to SEQ ID NO: 23645
  ENST00000627810

SEQ ID NO: 23655 - DNA, 626 bp, Homo sapiens; identical to SEQ ID NO: 23646
  ENST00000631242

SEQ ID NO: 23656 - DNA, 714 bp, Homo sapiens; identical to SEQ ID NO: 23647
  ENST00000629260

SEQ ID NO: 23657 - DNA, 490 bp, Homo sapiens; identical to SEQ ID NO: 23648
  ENST00000625917

SEQ ID NO: 23658 - DNA, 561 bp, Homo sapiens; identical to SEQ ID NO: 23649
  ENST00000628247

SEQ ID NO: 23659 - DNA, 3426 bp, Homo sapiens; identical to SEQ ID NO: 23650
  ENST00000627583

SEQ ID NO: 23660 - DNA, 7987 bp, Homo sapiens; identical to SEQ ID NO: 23651
  ENST00000626389

SEQ ID NO: 23661 - DNA, 396 bp, Homo sapiens; identical to SEQ ID NO: 23652
  ENST00000626141

SEQ ID NO: 23662 - DNA, 542 bp, Homo sapiens; identical to SEQ ID NO: 23653
  ENST00000626396

SEQ ID NO: 23663 - DNA, 1019 bp, Homo sapiens
  ENST00000592881
ccggacgtgaaagtttgctgcgtagggatagggagaccgggccggattgcggggagtgagcaggttcagcagtgacggcattcttaagagtcctgcccaagtgagggacttggggtgtgggacagagtggcccccagggcagtgggcgttggaaactgagaggccctgcgaaggaggcttggggaggggctacggtgaccaggggacgaggtataggaagaggagggcggaaagccttgagggtgggcttcttggatcccaattgccccagaggcacaggcctgggcatcactgtattatttcccgaggggagaaggggctatttcccatgggaagacaaagtgggatgaatagtggaccttgagaagagggggtggccaggaaaaggttcctgaaggaggcaggacccagactgcaggctggggagggtttgggcagccagagggaggtgagggtgctggagcgggggtcaatcggtcactccggccggagatctgagtggcctctgccccctctgcgctgtggagtgcatctgattgccagcctcgctggaccgttgagaggattcatcgagaccctggatatgaatatgcagtgtgaactgaagtttggggacatgagtaatcagtcacagtggcccaagatttgaggtgtaaatggagaagtcagaatgattcgctgcagctgtctggaacagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagcc

SEQ ID NO: 23664 - DNA, 1261 bp, Homo sapiens
  ENST00000325333
acgcctccggtcccctccccgcagggcgctccgcagaggcgaggggtgggagcgccggctccaggcggcggaacctccgcactgggctcgcgcgcttccggccggcgccttttcccagggactccgccaacccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacgggctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 23665 - DNA, 335 bp, Homo sapiens
  ENST00000590190
gcgcgcttccggccggcgccttttcccagggactccgccaacccctcgcacccccgcgcccccagtccccgcgtccccggcgccgccggcccggagctgcccggaagtctcggttccgccgccggcgctcgccaggggaagcccggggccgcccgggacctcggcccgttcctccggacccgagaggccgccgcacggggaaacttttcctaaaaggaagtggcaattttaactaatctcccctccgccgctcccagctgccgctccagatgctgctgctgccgccgcggccaccccaccctcggtcctcctctccggaggccatggacccaccg

SEQ ID NO: 23666 - DNA, 1707 bp, Homo sapiens
  ENST00000543039
ggaaggcatttgagccattttggggtgtatagatgtagtaagacgatgggttccgtagtggggagaggtgactagacttcgaggtgctaagtgtaggaacaggatggaaaagccctagtgaaatgtggggaattgggttagtggggctctggggaggtacctagagaggaagtgagggaggccacggaatatgaagatggggaggccctgcggcatgtagtggggacggagggccaggaggccgatacgggggccggtgggggggtagggggcggcaaagggaggggaagtaaactgaactggggctgggcaacaggaaaaaagaagaaaccacagattagagaaatctcggcggtcaggaggcccggggtctaagatgtaaagaggtaaacagatttagggattgattgtctgctggggtgggttgagaggagaaaagggaagaaaagtcgggggactacgtcctcagacctgacctgagtggtgagaggtggacccaggaggagtggcaggtggtggcggggttttgcagagctcagttggaggccctctccgaggcagcttgatggaacgtgggagagccgggctggagtcacagtttttattttgctagggaggtagtcagtggcgcacaaagggtaacaagcagtgatagtggggatgctttccattttaggaaacttttcctaaaaggaagtggcaattttaactaatctcccctccgccgctcccagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 23667 - DNA, 377 bp, Homo sapiens
  ENST00000592461
agattagagaaatctcggcggtcaggaggcccggggtctaagatgtaaagagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctc

SEQ ID NO: 23668 - DNA, 1025 bp, Homo sapiens
  ENST00000545125
agattagagaaatctcggcggtcaggaggcccggggtctaagatgtaaagagctgccgctccagatgctgctgctgccgccgcggccaccccaccctcggtcctcctctccggaggccatggacccaccgccccccaaggctccccctttccccaaggcggaaggcccctcctccactccttcctcggcggcggggccccgacccccgcggctgggccgccacctcctcatcgacgccaatggggtcccctacacatacacggtgcagctggaggaggagccccggggcccgccccagcgcgaggcgcccccaggagagcccggccctcgcaagggctacagctgcccggagtgcgcccgtgtctttgccagccctctgcggctgcagagccaccgcgtgtcgcactcggacctcaagcccttcacgtgcggcgcctgcggcaaggccttcaagcgctccagccacctgtcgcggcatcgcgccacgcaccgcgcccgcgccgggccgccgcacacctgcccgctctgcccacgccgcttccaggacgccgcggagctggcgcagcacgtgcgcctccactaagctcgagacccggcctgtgctgccctgcccgtctcagggccaccaagtctgacccacacagcgtcactcactcccacacacaccccctggctctgctgaggttactgccttaccctgggcctcagtttccccaccttccaaagggaggagcatcattccttccttaccccctttctagctgtgtgatgtagaccaaagtcgttgcccctccctgggcctgggaaccagtcggaactgggttccagtccagctgtgctgtgtgagcctgtgcaagtgacatgacctctctaaaccttggttttctgctctctggagcggtgaaccggtggttgtctgcggggaagagatgataaagagcacgggcacggtctggttcatttctgtatctaccccccttccgcccacgcccccgaccctttgctcaataaacattccgcactcc

SEQ ID NO: 23669 - DNA, 2316 bp, Homo sapiens
  ENST00000587817
ggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccagcaccgtgtcttgtgaactcccatcaccttcaagaaagcttccgagggtgaaggtacgctcgagcgtggtcaatgaggacaagtcaacgagagattcctgagtacgtctatggtcaccctttgcggtaaacttgtgcgctcagaagaagccagggtaacaatgggacaaactaaaaaaacgagagacaaattaattgactgttacacatttctgcaagcagaggttgccaacgcaggactggcaatagcatctgaaatcagactactactcctgcagaacaacatcttactggtaaaaaaaagaatagcccacatgaaggaaaactgatttggtggaaagacaacaacaataagacatgggaaatagggaaggtggtaacgtggaggagaggttttgcttgtgtttcaccaggagaaaatcagcttcctgtttggataccaactagacatttgaagttctacaatgaacctgtcggagatgcaaagaaaagcacctccacggagacagaaacactgcaatcaagcaccatcaactcacaagataaaatggtgatgtcagaagaatagatgaagttgccattcaccaagaaggcagagccgccgacttgggcacaattaaagaagctgacacagttagctaaaaaaggccttgagaacacaaaggtgacacaaactccagagagtatgctgcttgcagctttgatgattgtatcaatggtgcaccgtattctgctagtgagagcaagggaaggcgtgtggatccctgtgtccatggaccgacagtgggaggcctcgccatccatccatattttgactgaatctgcaggtgtacccaacagctccaaagagacagcgaccatcgagaacgggccatgatgacgatggcggttttgtccaaaagaaaagggggaaatgggaaaagagagatcagactgttaccgtgtctatgcagaaataagtagacataagagactccgttttgttctgtaccaagaaaattcttctgccttgagatgctgttaatctgtaaccctagccccaaccctgtgctcacagagacatgtgctgtgttgactcaaggtttaatggatttaccaaagggctatgcaggatgtactttgttaaaaaaaagtgcttgaaggcagtatgcttgttaaaagtcatcaccattctctaatctcaagtacccaggacacaatacactgtggaaggccacagggacctctgcctgggaaagccaggtattgcccaagatttctccccatgtgatagcctgagatatggcctcatgggaagggtaagacctgactgtcccccagcccgacatcccccagcccgacacccgaaaagggtctgtgctgaggaggattagtaaaagaggaaggcctctttgcagttcagataagaggaagtcatctgtctcctgctcgtccctgggcaatagaatgtctcagtgtaaaacccaattgtatgttctatttactgagataggagaaaaccaccttagggctggaggagagacatgctagtggtaatactgctctttaatgcaccgagatgtttgtacacgtgcacatcaaggcacagcaccttttcttaaccttgtttacgacacagagacttttgtttacatgttttcccgctgaccctctccccactattaccctattgtcctgccacatccccctctccgagatggtagagataatgatcaataaatactgagggaactcagagaccagtaagcaccggtcccctgggcccacttttctttctccaca

SEQ ID NO: 23670 - DNA, 670 bp, Homo sapiens
  ENST00000588723
ttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccagggtgaaggtacgctcgagcgtggtcaatgaggacaagtcaacgagagattcctgagtacgtctatggtcaccctttgcggtaaacttgtgcgctcagaagaagccagggtaacaatgggacaaactaaaagtaaatatgcctcttagctccattaaaattcttttaaa

SEQ ID NO: 23671 - DNA, 8618 bp, Homo sapiens
  ENST00000292841
agcctacaaaggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagttaaaaaaaaaaaaaacaaaaactagcccaatgtctgttgatgcccattaatcactaacacagtgtctgacccctccattaaattttgatggtatctcttggctccccattgtcccgttaacccaatgtctgctgattcccaatttcccacattgcttcatgcggttccttagtcacccttggctactgtacttcccccaagattgcatctccatgtttgcatggtcatgatccctggaagatggtgatgaggatgaggtcccagcctcatagaccttttcctctgagttccccccaaggcacaatggaatgatggacccagggtgggccagggatgatctggagatctcaggagaccacaagctgggcttcctgtctactacatgagtatggtgtgagcagaacagtgaaagctgtctatgttggttcaaattctggtgccaacactgatccacttagggaccctcagcctgcccagaaacctcctctgggcctcaattttctcacttgtaaaatgggattatgggagaatgaagtgactttttttgggtcacatgatggatgggatccaagccagcagggcccaatgacagcatcctgttaatattagtcatcagtcaacataagcatctgactatcctctgtatgcccaagcctcatgaagggaaacaatttattgtaaatgacttttgattatttctcttatatatttattgtaacaatattataatacttacgtatatgtatatgcatatacccgtatatacggaaggctttattttttagagtagttttaggttcaaagcaaaattgggtagaaattacagaggtttcccatatatcccctaatccacatatgcatagcctcccacattatcagcattcctctcagagtagtatatttgttacaattggtgaacctccactgacactcattaccaccccaagtctataggttatattagggttcatccttggtgtaacaccatagaatgtgtcttgtactttctgcttgttggagcaagtggatcatggcatgtttccactgttatacacagagtagtttcactgccctaaaaatcctctgtgttctgcctgtcatcccttcatctcctctaatcctggcaacattttttctgtctccatagttttacctttgatcttttatatcatatagttgaaattatacagtgtgtagccttttcaaattgacttctttcacttagtaatgtggatttcagtttcctccatgtcttttcatggcttgataatgcatttctttttagagccaaattatgttccatcgtctggatgtttatttattcacctactgaaggactgttggatgcttccttttggcaattatgaggaaagctgttataaatatctgtgcaggctttttgtgtggacataactgaaatatttttaaagttatatttattgaggtataatttacattcagtaatagtcacactttttagtgtagagttctgagttttgacagttgtatctaatcatgcaatcaacaccacaatcaagatgaagaacaggcccctcacttccctaacttctttcctatccctttttagtcccttttcccactcccagcccttggcaatcaccagtctgtttccgtctctatagttctgccttttccataatattgtataagtggagtccttgtgtgtgtgtgtgtgtgtgtgtgtgttttgtacgtgtatgtatatctccttttgagtcggagtgctttcatttaatgtgatgtatctgagattcatccatatggttctatgaaaaacaaatggaaaataaggtgatgaaaagatgctcaacatctttaattatcaggaaaatgtaaatcaaaccacaatgagatactactatagaatggcttttagaatggctaaaaatgaaaacgtgccataaattggcaagaatacagaccaatggaaattttcatgcattgcttgtaggattgtaaaacggtctgtccactatgcacaaaagtttggcagcttcttatactattaaccatacatttatcatatgactcagcaactccacacttaggtatttaccctagatgaaagaaaaattctgtttacatgaaaacctatactcagatgttcacagcaattgtataattgcccaaattaggaagtaacacaaatgtacatcagtggatgagtgattaaacaaattgtgtacaccaatactatggagggctgctcagacataaagaaatgatttattgacacttactacaacatggatgaatctcaaaagtgctgttgtattttaggtaaaccatgtgataacttgaattacatttgataaaagatttataagtgtaaaaactagatttatatattttaattttatatgtgcctgtcattacatactatagaaaattgtgtctacagtatgttatatagcatattgtaatatttattactgtatattccttgtgacaataaaatagtttgtattttatataatagtacctgttttatagtatatgttttattttatatgattacctaattttaatattttacatatcaaactttcacataatattttggttatttctactttcacgtagttgcatttaatgtttgtagtgtaaagatataactacaataaaagaggccagagagtctgcagttggagttagtcaacatttttatttgtcaggcatctcaattctggctgttttaacatcaaggatcttttctctggctttgggcctttgcaccgactgttctgagagtgctctgcttctccagtgcccgtgcatcttgctttcctcttccacctttgcagtgcctccatccccatcttatcctgccattgaagtaacacatctgtagagctcacttgctgctcccttattttgtatgatatttgcattgcaaatactattactatctgacctgattcaatattcctttttttggtttctcatccctcttccccactggaccatcagcctcatgagaaccagactttgtctgtcctgtttctgctgtataccaggcgcccagcacggtgccagctcaaagcagatgctcagtacaagcttgttaaatggatgaatgaataatagcaataatatcgaggttgaccagatgccccgcacagattggtaacatgtgtggggaagttggtggggtgggtttgggtcctctaattcaagatttaatgcctcctcccaccatggtccagcacacccagctctaactccatgtcagggcagtaccaaactgagtatcctacctacatacattccacactgtttacaagatctaacttagcctcctcctggtcacagtggcaggtcacatagagggggaaaggggcaggagtgggggatccataggcagggggccactcccatcagcatctagcctagcactttctatcctgcaccccattgtcagtgtcacctgccccacctcctccactggagcagccactggaaaatatagaaccccaggagcaagaggaatgtggcagggctgagggttctggggctcaggcaccttgttggataatggatgtgatgcagtgtggcagacattgaccccgtggccaaagtcagcttaaagccaaggttgtcatggacacttcccataatgccaggatgaatcacaccctccaccctcagctctcaaatgggctactagtgccaatgtgactattttttatttttattttttttgagatggagtctcactctgttgccaggctggagtgcagtggtgtgatcttggctcactgcaacctctgcctcccgggttcaagtgattctcctgcctcagcctccgagtagctgcgattacaggcacccaccaccacacccagctaattttttgtatttttagtagagatggggtttcaccatgttggccaggatggtctcaatctcctgacctcacgatttgcccacctcggccacccaaagcattgggattacaggcctgagccacctcgcccaacccagtgtgactatttatggtatatcctacacctccccaccacactctactccacattcctcataccgtaccataccgtacaccatgccatagcataccacttacagttttacttaattctataattatattgtttctattaatggttttaaatataatcaacacaattatactttataacaaatatcagaatccttgtcattattatatgcctctaaattattaagatatcataaataacaacatatcaattctgatgctaagaaatcctctgtctctgctagtttctgccaccttcaggtgtttgtattatataaacacagtagtcccacccctgggctgatgttttccaccctctgtgaaatcagcacaattaggttacatccttagtgattttattatggtgttattttaatatttattataacaaggaatgctgctattaaaacaaaaaattgtgctctctgtttacatttgtgaaataggacaatataagaagcacattagtacaatcatttgagttatattaagtttgtgcctataataaatgccaatcctgaaaa

SEQ ID NO: 23672 - DNA, 3190 bp, Homo sapiens
  ENST00000392157
agtgatgggagtctgtggtcagtgacagagcctgtagggtcagttatggtgatcggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgta

SEQ ID NO: 23673 - DNA, 596 bp, Homo sapiens
  ENST00000588354
tcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctagtaggtttttactgggattagtgaaacaactgctatgttctcagcaacccactccaaagccaaagtcaaaactaaaattgtaaaatatctcaaaaacaataaaaatggtatatatatatcagaagctctggtatatagcaaaactgtactaaaaataatttagaaaaataatttatctcatgcaaatgaataaaaaaatctaaatgaaaa

SEQ ID NO: 23674 - DNA, 6822 bp, Homo sapiens
  ENST00000356958
agcctacaaaggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaatcctcagttataaacaagtatcctctcaacctcaaaaaatgtatcctggggagaaagcttatgaatgcgccaaatttgaaaagatattcacccagaagtcacagctcaaagtacacctgaaagttcttgcaggagaaaagctctatgtatgcattgaatgtgggaaggcttttgtacagaagccagaatttattatacaccagaaaacccatatgagagagaaaccctttaaatgcaatgaatgtggaaaatccttttttcaagtgtcgtccctcttcaggcatcagagaattcataccggagagaaactctatgaatgcagccagtgtgggaaaggcttctcttataactcagatctcagtatacatgagaaaattcatactggagagagacaccatgaatgcactgactgtggcaaagcattcacacaaaagtccacactcaagatgcatcagaaaatccatacaggcgagagatcctacatctgtattgaatgcggacaggccttcatccagaagacccatttgattgcacaccgaagaattcatactggagaaaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagttaaaaaaaaaaaaaacaaaaactagcccaatgtctgttgatgcccattaatcactaacacagtgtctgacccctccattaaattttgatggtatctcttggctccccattgtcccgttaacccaatgtctgctgattcccaatttcccacattgcttcatgcggttccttagtcacccttggctactgtacttcccccaagattgcatctccatgtttgcatggtcatgatccctggaagatggtgatgaggatgaggtcccagcctcatagaccttttcctctgagttccccccaaggcacaatggaatgatggacccagggtgggccagggatgatctggagatctcaggagaccacaagctgggcttcctgtctactacatgagtatggtgtgagcagaacagtgaaagctgtctatgttggttcaaattctggtgccaacactgatccacttagggaccctcagcctgcccagaaacctcctctgggcctcaattttctcacttgtaaaatgggattatgggagaatgaagtgactttttttgggtcacatgatggatgggatccaagccagcagggcccaatgacagcatcctgttaatattagtcatcagtcaacataagcatctgactatcctctgtatgcccaagcctcatgaagggaaacaatttattgtaaatgacttttgattatttctcttatatatttattgtaacaatattataatacttacgtatatgtatatgcatatacccgtatatacggaaggctttattttttagagtagttttaggttcaaagcaaaattgggtagaaattacagaggtttcccatatatcccctaatccacatatgcatagcctcccacattatcagcattcctctcagagtagtatatttgttacaattggtgaacctccactgacactcattaccaccccaagtctataggttatattagggttcatccttggtgtaacaccatagaatgtgtcttgtactttctgcttgttggagcaagtggatcatggcatgtttccactgttatacacagagtagtttcactgccctaaaaatcctctgtgttctgcctgtcatcccttcatctcctctaatcctggcaacattttttctgtctccatagttttacctttgatcttttatatcatatagttgaaattatacagtgtgtagccttttcaaattgacttctttcacttagtaatgtggatttcagtttcctccatgtcttttcatggcttgataatgcatttctttttagagccaaattatgttccatcgtctggatgtttatttattcacctactgaaggactgttggatgcttccttttggcaattatgaggaaagctgttataaatatctgtgcaggctttttgtgtggacataactgaaatatttttaaagttatatttattgaggtataatttacattcagtaatagtcacactttttagtgtagagttctgagttttgacagttgtatctaatcatgcaatcaacaccacaatcaagatgaagaacaggcccctcacttccctaacttctttcctatccctttttagtcccttttcccactcccagcccttggcaatcaccagtctgtttccgtctctatagttctgccttttccataatattgtataagtggagtccttgtgtgtgtgtgtgtgtgtgtgtgtgttttgtacgtgtatgtatatctccttttgagtcggagtgctttcatttaatgtgatgtatctgagattcatccatatggttctatgaaaaacaaatggaaaataaggtgatgaaaagatgctcaacatctttaattatcaggaaaatgtaaatcaaaccacaatgagatactactatagaatggcttttagaatggctaaaaatgaaaacgtgccataaattggcaagaatacagaccaatggaaattttcatgcattgcttgtaggattgtaaaacggtctgtccactatgcacaaaagtttggcagcttcttatactattaaccatacatttatcatatgactcagcaactccacacttaggtatttaccctagatgaaagaaaaattctgtttacatgaaaacctatactcagatgttcacagcaattgtataattgcccaaattaggaagtaacacaaatgtacatcagtggatgagtgattaaacaaattgtgtacaccaatactatggagggctgctcagacataaagaaatgatttattgacacttactacaacatggatgaatctcaaaagtgctgttgtattttaggtaaaccatgtgataacttgaattacatttgataaaagatttataagtgtaaaaactagatttatatattttaattttatatgtgcctgtcattacatactatagaaaattgtgtctacagtatgttatatagcatattgtaatatttattactgtatattccttgtgacaataaaatagtttgtattttatataatagtacctgttttatagtatatgttttattttatatgattacctaattttaatattttacatatcaaactttcacataatattttggttatttctactttcacgtagttgcatttaatgtttgtagtgtaaagatataactacaataaaagaggccagagagtctgca

SEQ ID NO: 23675 - DNA, 4364 bp, Homo sapiens
  ENST00000355202
gatctgcgcatgcgcactcgaggcaaggcggccactcccagaagtctccggggctcgagcggtgggtgggaggcgcggtccaagtggtcgctgccgtatttctcgtaggtttttaggattctggactccatttctcaccggtacctgcggtcctgactgttctggcttggactacatattacaaaggcaacggagaaaacttggacccctggctccggttccgggaccttttggttccacctgaagaaggcggcgcaggtcactgcgggagcctctgcagccccagcccgccgcccgcgtggtaccctgcgtggcggtgagagtggggctgcaggaggcgctcagagcgcggaggcccccaggcgggccgggcgagtctcccgcctcctcaggccctagggtgctggagctgcggaggaggggcccgtctctaggagacaggcggggagcgtgagagaccgcgcagcggcgacaggaccggcttgcctgtgtgacgtgggtgcagttgcgggactgtgaggggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattggcaggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacaggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagaaaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcacagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatataataatatca

SEQ ID NO: 23676 - DNA, 4003 bp, Homo sapiens
  ENST00000395835
attgacccttggctccaggttccctgctgcttcctgtgccttcctcagcctagtacgactacaacagagaaatggtcccaatgggaaatcagatactgagtcttagatgaagatttccagtgagaagaaacagataggatgagaagcttagaagagtaattgcccttaagaaaggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattgggacattccgtatctaagccagatttaatcaccttattggagcaaggaaaagagccatggatgattgtgagggaagaaacaagaggagagtgtacagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaaagtacatcagagtattcatactggagagaagccacatgaatgtaaggaatgtggaaaggcctttcgtcagttttcccaccttgtgggtcataaaagaattcatactggagaaaaaccctatgaatgcaaggaatgcgggaagggctttacatgtaggtatcaacttaccatgcatcagagaatttattcaggggagaaacactatgaatgtaaagaaaatggggaggcttttagtagtggccatcaacttactgcacctcatacatttgaaagtgttgagaaaccttataagtgtgaggaatgtgggaaagcctttagtgtgcatggacgacttactcgacatcagggtattcatagtggtaagaaaccctatgaatgtaacaaatgtgggaagtcctttaggctcaattcatcccttaaaatacatcaaaatattcataccggtgagaaaccctacaaatgtaaggaatgtgggaaggccttcagtcagcgtgcacaccttgcccatcataacagaattcatactggttacaaaccctttgaatgtaaagaatgtgggaagtcctttcgttgtgcctcatatcttgttatacatgagagaattcatacaggagagaaaccctatgtatgtcaagagtgtgggaagggttttagttatagccataaactcactatacatcgcagagttcatactggtgagaaaccttatgaatgtaaggaatgtgggaaggcctttagtgtatctggacaacttactcagcatctgagtattcacagtggtaagaaaccctttgaatgcaacaaatgcgggaagtcttttaggttcatttctgtacttaaagcccatcagaatattcatagcgctgagaaaccctacgaatgtaaggaatgtggcaaggcctttcgtcatgccacaagcctcatatatcatgaccgaactcatgctggtgaaaagtcctatgaatgtaaagaatgtggggaaacttttagtcatgcttcacatcttattattcatgagagaattcataccagtgataaaccctatgaatgtaaaagatgtgggaaggcatttcactgtgcctcatatcttgttagacatgaaagcgttcatgctgatggaaatccctatatgtgtgaagagtgtgggaaagcttttaatagtagccatgaacttagtatacatcatagagttcatactggtgagaaaccctttaaatgtaacaaatgcagaaggtcctttaggcttagatccatccttgaagtacatcagagaattcatatttgatagagaaattgtggcatatacaggtagtaaagaaagcacattgtgtcaatggatttatcccactgaacaatttgaatgaagacaatgtggaatggctttgagatacagttcagtttttattaggcatcaatttgtattggtgtgaacttttcaaaatgtaaatcatatatgcagtttctttggtatgacctgtgttaactcagattcagagaatttataatgtatttttttaataacataagaaaacttttctgatattcctctagttttggattgccaaaatattcacagtagaggaaaactgagaaaacgtaggaaaccattctttatacttgcatgtaaacatcttccagcaacaatcatttattgttaaacctggaaaaagccattacacaggaaacctctgttgatataagcgatgatgggaaaggctatttagccactctgcatatttaatgctcatgatcaacatctgcttcctatagctgggatgatatgggggaagatatttatcccttctggggatcatatataaatgatgatagtagtacctacagtatagtgctgttagaattacatgagttagatgtggaggtcagagtggaagcaggtgtgagagggtcccgcagaagaaaacatggctgccaaagtgtttgagtccatcggcaagtttggcctggccttagctgttgcaggaggcatggtgaactctgccttatgtaatgtggatgctgggcacagagctgccatctttgaccaattccgtggagtacagaacattgtggtaggggaagggactcactttctcatcccatgtgtacaaaaaccaattatctttgactgctgttctcaaccacgtagtgcgccagtcatcactggtagcaaagatttacagaatgtcaacatcacactgtgcatcctcttccggcccatcactagccagcttcctcgcatcttcaccagcattggagaggactacgatgagtgtgtgctgccgttcattaccacggagatcctcaagtcactggtggctcgctttgatgctggagaactaatcacccagagggagctggtctccagccaggtgagcaacaaccttatggagtgagcagccacctttgggctcattctggacgacgtgtctttgacacatctgaccttcttgaaggagttaacagacaggtggccccccaggaagcagagagcgccagatttgtggtggaaaaggcggccatcatctctgctgagggtgactccaaggcagctgagctgatcgccaactcactggccactgcaggggacggccagagcgagctgtgcaagctggaagctgcagaagacattgcataccagctctcatgctctcggaacatcacctgcctgccggcagggcagtccgtgctcctccagctgccctagtgaggccccagcctacctgcacctccgtgaggcaactgggccacagccccgatgattcgtaacaccacctttcgccctcaccccagaaatcactgaaatttcatgattggcttaaagtgaaggaagtaaaggtaaaatcacttcagatctctaaaaaacaaagaattacatgagttagtacatgaaaaaattatgggaaactacatgaaatatactgttacgttcaataaacattagcttctgtatat

SEQ ID NO: 23677 - DNA, 1190 bp, Homo sapiens
  ENST00000586559
acagagaaatggtcccaatgggaaatcagatactgagtcttagatgaagatttccagtgagaagaaacagataggatgagaagcttagaagagtaattgcccttaagaaaggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattgggacattccgtatctaagccagatttaatcaccttattggagcaaggaaaagagccatggatgattgtgagggaagaaacaagaggagagtgtacagcagagctacagagtaaaaattgtggattccaactgagagacctgcaagacagtctccatttaagaaagaattgctagggaaacccaaagagaagacataaataaagactggaagaattgaagctgcaacacaaacacagctacagcacacaatgaacacggcctaactcctacgcagacgaacctcaaactttgcactgaagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtggggaagcttttaggactagccgtcaacttactgtacatcatagatttcattatggtgagaaaccctacgaatgtaaggaatgtggcaaggcctttagtgtgtatggacgacttagtcgacatcagagtattcacactggtgagaagccctttgaatgtaacaaatgtgggaagtcctttaggctcaaagcaggccttaa

SEQ ID NO: 23678 - DNA, 549 bp, Homo sapiens
  ENST00000590670
ttgacccttggctccaggttccctgctgcttcctgtgccttcctcagcctagtacgactacaacagagaaatggtcccaatgggaaatcagatactgagtcttagatgaagatttccagtgagaagaaacagataggatgagaagcttagaagagtaattgcccttaagaaagatttggattcaagatgtgaaataatcagcgatgggaaaatgcagctttataggaaacactcatgtgttactctccatcagagaattcataatggacagaaaccatatgagtgtaagcaatgtcagaagtcctttagtcatcttacagaactcatggtacatcaaacaattcatactagtgaggaacctgatcaatgtgaaaagtttaggaaggcatttagccatcttacagaccttagaaagcatcagaaaattaatgctcgtgagaaaccttatgaatgtgaagaatgtgggaaggtcttcagttatcctgcaaaccttgctcaacatgggaaagttcatgttgagaaaccctatgaatgtaaagagtgtgggga

SEQ ID NO: 23679 - DNA, 741 bp, Homo sapiens
  ENST00000591664
gggaggcgcggtccaagtggtcgctgccgtatttctcgtaggtttttaggattctggactccatttctcaccggtacctgcggtcctgactgttctggcttggactacatattacaaaggcaacggagaaaacttggacccctggctccggttccgggaccttttggttccacctgaagaaggcggcgcaggtcactgcgggagcctctgcagccccagcccgccgcccgcgtggtaccctgcgtggcggtgagagtggggctgcaggaggcgctcagagcgcggaggcccccaggcgggccgggcgagtctcccgcctcctcaggccctagggtgctggagctgcggaggaggggcccgtctctaggagacaggcggggagcgtgagagaccgcgcagcggcgacaggaccggcttgcctgtgtgacgtgggtgcagttgcgggactgtgaggggtcttggttcttttgactttgctcttctggtagagaaacgccaaggactgatcaactcttgccagtctcaaaccatgtcctatggatcaataacattcggggatgtggccatagacttctctcatcaggagtgggaatatctcagcctggttcagaagaccttgtaccaggaggtgatgatggagaactatgacaacttagtctcattggatttggattcaagatgtgaaataatcagcgatgggaaaatgcagctttataggaaacactcatgtgttactctcca

SEQ ID NO: 23680 - DNA, 3349 bp, Homo sapiens
  ENST00000331569
gctatttgacgtgcggctcgaggaaggcgaaggtttttgtgttgctagccggggccagcggcggtggcggcggcggcggaggcgtcggtggaggaggggaggcggcgaggaggcgcagctcccgctgcaccgcgatcgacgctgcggagcgagcccacccgccccgggagctcgcctccccggtgctcccccgccctccccgcccccccagcggcgctgcctcctccaaatgagcgattcgcccgctggatctaacccaaggacacccgaaagcagcggcagcggcagcggcggcggcgggaagaggccggcggtgccggcagcggtgtccctcttgccaccggcggaccccctgcgccaggcgaaccggctcccgatcagggtcctgaagatgctgagcgctcacaccggtcacctcctgcacccggagtacctgcagccgctgtcctccactcccgtcagccccattgagctggacgccaagaagagccccttggcgctgctggctcagacctgctcgcagatcggcaagccggacccgccgccctcctccaaactcaactcggtggcggcggcggccaacgggctgggagcggagaaggaccccggccgctcagccccgggcgccgcctccgcagccgcggccctgaagcagctgggggactcaccggccgaggacaagtccagcttcaagccctactccaagggctccggcggcggcgactcccgcaaagacagcggctcctcctcggtgtcttccacctcctcctcgtcctcctcgtccccgggagacaaggcgggcttcagggtccccagcgccgcctgcccgccctttcccccgcatggagcgccggtctccgcatcctcgtcctcgtcgtcgcccggcggctcccgcggcggctccccgcaccactctgactgcaagaacggcggcggggttggcggcggggagctggacaagaaagaccaggagcccaagcccagcccggagccggcagccgtgagccgcggcggcggtggggagcccggggcgcacggtggcgccgagtccggggcctccgggcgcaagtccgagccgccctcggcgctggtgggggccggccacgtggcgccggtgtctccctacaagccgggccactcggtgttcccgctgccgccctccagcattggctaccacggctccatcgtgggcgcctacgccggctacccgtctcagttcgtgcctggcctggatcctagcaagtccggcctcgtgggaggccagctgtctgggggcctgggcctgccgccgggcaagccccccagctccagcccgctcaccggggcctccccgccctccttcctgcagggattatgccgcgacccctattgcttgggaggttaccacggcgcctcgcacctcggcggctccagctgctccacctgcagcgcgcacgaccctgccgggcccagcctgaaggcggggggctacccgctggtgtaccccgggcacccgctgcagcccgccgcgctctcgtccagcgccgcccaggccgcgctccccggccacccgctctacacctacggcttcatgctgcagaacgaaccgctgccgcacagctgcaactgggtggcagccagtgggccgtgcgacaagcgcttcgccacctcggaggagctgctcagccacctacggacccacacggccctgccgggagccgagaaacttctggccgcctaccccggggcctcgggcctgggcagcgccgccgccgccgccgccgccgccgcctcctgccatctgcacctccccccgcccgccgcccccggcagccccgggtcgctgtccttgcggaatccacacactttgggcctaagccggtaccacccctatggcaagagccacttatccacagcggggggcctggccgtgccgtccctccccacagccggaccctactattcgccatacgcgctgtatggacagagactagcttcagcctcggcgctgggataccagtaactacagctcttcctccaccccagccccctcaccctcctccctctccctcctcctccctccccacctgccgtcgccgctgcaacctccactactgcttgaccctgccgggattccccacccagcccttccccaccggactgtgtatttatttactataatgttagcttacaagctgggaatataagtgcattaacggcccacatgagtcaatggtatgcaaaaagtctgtgttctcccaaataataatattaatcccacaaataacgacatgatccccgcccctgttcctttctgttattttttcttagatataagttttacattttttattccttttcctctttttttggttttgattggtttggtttgagggagagttggggtctttgggttcttctagacgttttgttttcccttcctggggagtttcttgcatgagtcttaacttaaaactacgtttccgccttctctttttccctcttcccccttcattccctcttgtttccttccatttgcggttctgtttttgttttttgttttgttttgttttgttttttcctttgttgtacaagtaacagagaggaggttttttttgtaactcattttgggggtggagggggccacctgggtggcaggggccctggagctctattgacctggtacactgctccgggactcctcccccgccaccctccgcgcatagggtccttggtctggaccctgccccccaaaagtagggccttgctcctctaccttgctctgagcacggagagccctgaccccaccagtaggctcgcccccagaagggcccaagtggccgtctaccgtcaccttccagactcccgcccctaacacccagtggctacagtgcgcctgtcggggcacctggagcgctcacctggttgaattcaaagtcccagaaggccccgctggcgtgaagccggccccttacattttgcgaagtgcattatagtccttgtttttctctccctcgtgggggcaacgacccctcccctggcagtaggggtggggtaggtgactctcgctagatccctccaaagcagaccggtggcgatgtcagcggatgtcacgagctcgttagctgcgttcggggaaggttggggcgtcagggagctctcggatcacagcagcccccgccctctcctaggcctggcccggcagagcccccagagtggaccccccagcgactggggtcttctccccactcctccctccttctggtctgatgcggcagcgcgggggctgcggggcctgtttgggacgaacagagctctcccttggtaagacttattttgttaataaatggaatacttggctatattcaca

SEQ ID NO: 23681 - DNA, 4124 bp, Homo sapiens
  ENST00000373165
cggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcactt

SEQ ID NO: 23682 - DNA, 2887 bp, Homo sapiens
  ENST00000276123
gccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctaatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagctt

SEQ ID NO: 23683 - DNA, 4844 bp, Homo sapiens
  ENST00000360700
acactaaaacaccaccattttggttcccaaccgtctcccacgtagcggggcagaggaagctggaggaggctgaggggctgggcagcacggcgtgggtagcagcggtggcgaccgctgcaccaagtaaagagagcgttttcccaaagaaaataacatagcacagaaggaaaaataaaaagaaattgctgcagattttactttatgtgagaaaatctacaatttcttcgagacactcatataaaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctagtaatgtataaatatcctaactattgtttgttgtcatctcgttcttcttttataacctatgttttaactggaacttttagcactgcagttttgttgttttgctttcttctaccacttccctatggctcatcagcttgactgtgcctttgtctccattatttttggtttacttccacttggcacttcttttatttatggttgtcacataaagcatctaaccatggtttttctttgttttgctttcttttgtaataagctttccacacttggttgaaaggcatattgtcaattgcatttttttctcaaaacaactaactttggactaaatatattaaactattttaaaagccatttcttttgcagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagttgcgctgaaatagcagatgaagtttacatggaagtcattgtaggggaagaggaaggaacttctctccctgagattcagcttgaggactctgatgttaataaaacagttgtccctgttgtctgggctgcggcatatggagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaa

SEQ ID NO: 23684 - DNA, 578 bp, Homo sapiens
  ENST00000493036
gctacgagcggttaagagactacagctcccaggatgtacggtgatggcacccgtttggactccgcccctctgcgcgtctagagctgttctcccgtgcggaggggatcctggctgttcccaaatctcgcctgcctgcgaggagccagcgtggcccgggcagctgatctcaacctgtgattgtgacatcacccctacctgaggaagcctcttccagcctgctcaagtttttcagattaactaagtaattcatattgtacatttctgaaattgaagtacgcacagcttcaattctgtgcagggaggatgcagcaggagagaatatcctgggcacatctttctggagaatcacttttactacaagatttgtaagaaacaaatttatttccaagggtggccaacttgggtgtcttcctctgccagggtcaaggacaaggattgaaacgggtggggcctggagccctagccaatcagtggcgccagcgtgaaactgtccaatcaagtgcgcagctacagaggaagaggcggcctcttcaatatggcggggcctttgtctcctagcttccgggctctgatcctag

SEQ ID NO: 23685 - DNA, 1027 bp, Homo sapiens
  ENST00000465343
agagctgttctcccgtgcggaggggatcctggctgttcccaaatctcgcctgcctgcgaggagccagcgtggcccgggcagctgatctcaacctgtgattgtgacatcacccctacctgaggaagcctcttccagcctgctcaaggttgccgtagttaggtttaccctcccttccttccctcaccccgtcctttccctcatccctgccccttcctctgtcccacgcggctttcagacatgcatagtgcagcccctcagtaaaggtgcagctaatggcccgtgggcctagcagttgtcaggccttttgggagcccatgatgggagctccctgatcctcctctgtaccccaagaacaccccattggatttccgggctggctgcttggcctacacacctgggtcaggcctctcgcagggatgcgcctgccactgtaataaagaggagaaaacgtcacacgggaaaggcctgactccttcgtacaatcagaatactcaactgcacagagaagggacccctttaagccactttgggagccacatccaccactctgtgactcccacacaggctggttcccaggtatcaggtgtcctagtgttaacacgggccaaaaggacaaaacaggaccctaggtccttcccaaaacattaggaaagtttgtgtactgagtttttcagattaactaagtaattcatattgtacatttctgaaattgaagtacgcacagcttcaattctgtgcagggaggatgcagcaggagagaatatcctgggcacatctttctggagaatcacttttactacaagatttgtaagaaacaaatttatttccaagcccctgggaaacactctcctacttggtgttttctatgactttaactactcttaagtaccacatatgagaagaatcatatagtaaagaaatcatgaggaagaatgataaaaaatgtatcacatgcttattaattttcaataaaaacaccaacagagatcagtagtacctgttgattataaataaacagataaatgag

SEQ ID NO: 23686 - DNA, 490 bp, Homo sapiens
  ENST00000492322
gggacccctttaagccactttgggagccacatccaccactctgtgactcccacacaggctggttcccaggtatcaggtgtcctagtgttaacacgggccaaaaggacaaaacaggaccctaggtccttcccaaaacattaggaaagtttgtgtactgagtttttcagattaactaagtaattcatattgtacatttctgaaattgaagtacgcacagcttcaattctgtgcagggaggatgcagcaggagagaatatcctgggcacatctttctggagaatcacttttactacaagatttgtaagaaacaaatttatttccaaggtaagaaattaaaactctaaaacaaggctagaaagtcatctgcctttaataacccttagtcatctgtgcctgatatgtgagactttctccaagataaatctctcaaggataacctattttccatcattataattagtaaaaattagaaattttagaaagtcaattg

SEQ ID NO: 23687 - DNA, 424 bp, Homo sapiens
  ENST00000606716
actctgtctcttaaaaaataatataaaaatttaaaataattttatacattatgttaaaatacacataaaattaactattttaaccattttaaaggtttccattgagatgaattaagtacactcattattttgctaccatcatttccatatataaaaagcatattccattttttgaaactgaaactgtacccattaaacaactccttattctccctgtagcccctgggaaacactctcctacttggtgttttctatgactttaactactcttaagtaccacatatgagaagaatcatatagtaaagaaatcatgaggaagaatgataaaaaatgtatcacatgcttattaattttcaataaaaacaccaacagagatcagtagtacctgttgattataaataaacagataaatgagaaaaaggaa

SEQ ID NO: 23688 - DNA, 562 bp, Homo sapiens
  ENST00000438373
gtgcctgcccagctggagtgctgggcccccggggtcaccatgcagcagggcctgacactgaccagggagccatggccacaggctcttggcagctggcccaaaataaatattctccataacctctgccgatctgctggaccctcacctctcagtctcactgagccactccgttaactggaggcagacccaaaattgctccacaggctgaagggtggccaacttgggtgtcttcctctgccagggtcaaggacaaggattgaaacgggtggggcctggagccctagccaatcagtggcgccagcgtgaaactgtccaatcaagtgcgcagctacagaggaagaggcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggct

SEQ ID NO: 23689 - DNA, 743 bp, Homo sapiens
  ENST00000488621
ctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactatggaaacctggtctccttgggtcttgctatctttaagccagacttgatgacctgtctggagcaaagaaaagagccttggaaagtgaagagacaggaggcagtagccaaacacccaggtaggtgggagtgaatgaagcagatgacacaaatgacggatcccaatgtcaaggaggaagccaaacctttaaacatgcttccagaagctctgctccagtggaaatggtttctgagaaaccttcatttctttctcttgctttaacatagggacattttttgtcccattcttgtgaattttccaagcactgtacttccccttcagtaatgtgtgtgtgtgtgttgtgtgtgtgttttgttttgttttttgtttttagtttacagcaataatgaaagtctttcatggcttgacagaaaatgtgtgatttgactgcttttccattgctttggggaaacagcaatatctgtatttttgagaaactatattaaaccatttttttaa

SEQ ID NO: 23690 - DNA, 7119 bp, Homo sapiens
  ENST00000423484
actgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactatggaaacctggtctccttgggtcttgctatctttaagccagacttgatgacctgtctggagcaaagaaaagagccttggaaagtgaagagacaggaggcagtagccaaacacccagctggttcttttcattttactgcagagatattgccggatcatgacataaaagattcatttcaaaaagtgattctgagaaaatatggaagctgtgaccttaataatttacatttaaagaaagactaccaaagtgtgggtaattgcaaggggcagaaaagcagttataatggccttcatcaatgtttgtcagctacccatagcaaaacctgtcaatgtaataaatgtggcagaggttttcagttgtgctcaatcttcactgaacataaagacatttttagcagagagaaatgccacaaatgtgaagaatgtggcaaagactgtaggttgttctcagattttactagacataagaaaattcatactgtagagagatgctacaaatgtgaagaatgtggcaaagcgtttaaaaagttttcaaaccttactgaacataagagagttcatactggagagaaaccttacaaatgtgaaggatgtggcaaaacttttacctgctcctcaacccttgttaaacacaagagaaatcatactggagacagaccctacaaatgtgaagaatgtggcaaagcctttaagtgcttctcagaccttactaatcataagagaattcatactggagagaaaccctacaaatgtgaagaatgtaacaaagcctataggtggttctcagaccttgctaaacataagataattcatactggagacaaaccctacacatgtaatgaatgtggaaaagcttttaagtggttctcggcccttagtaaacataagagaattcatactggagagaaaccctacatctgtgaagaatgtggcaaagcctttacccgctcctcaaccctttttaaccacaagagaattcatatggaagagagaccttacaaatgtgaagaatgcagcaaaacctttaagtgcttctcagacctgactaatcataagagaattcacactggagagaaaccctacaaatgtgaagaatgtggcaaagcatcgagctggttctcacacctcatcagacataagagaattcatactagagagaagctccacaagtgttaaaaatgtggaaaagcctttaccaagtcctcatactgtgttcaacatctgaaatttaatactgaacaaatgcagtataaatgtaatgacagtggaagaacatttatcatcttagagggtctctaagaacttactttataatctggttgcttatatgttgggtacatatatagccctttgctattatgtaatgccctttttttttaaatctatgttaatttcaagtctgttttgtcagaaactaggattgcaacccctgcttcttttcctgttttctatttgcttggtaggcttttctttttccctttattttgagcttatttgagatgggtgtcttgattaaagcataccattagatcttgattcttttttcagcttgccatctgtgctttaatttgggtatttagcccatttacatttaaggttagtattcatatgtgtggattggattctgttattaggatcttagctggctattttgcacatttgtttctgtggttgctttatagtgtccacagtttgtatactttagtgtgcttttgtagtgactggtaatagtctttttcttatttaatgctttcttcagaagctcttttaagacagatcctgtggtaacattttctcagcatttgcttgtctgaataggatcatatatattttttacttctgaagcttaccttggtcagatatgaaattctgtgttggaattctttttttaagaatgttgaatattggcccctataatctcttttgacttgtaggatttcagctgaaagatttgttgttttcctgatgagcttctttttagaggtgacctggcctttctctctagctgcctttaacatattttttctttcattttgaccctggagaatctcatgattatgtgtcttgaggatgaccttctcctggggtatcttactggggttctccacatttcctgcatttgaatgttggcctctctaggttggggaagttctcatggatgttatcctgaaatacgtatttcaagttgttttcattctccccatcactttcaggcaatctcttgcatcatagatttggtttctttacataatcccatatttcttagaggttttgttcattcctctttattcttttttcactgttcttgtctgtctgatttcagaaagccagtcttgaggccctgagattctttcctctgcttggcctattctgctgttaatatatgtgattacattataaaggttttgtattgtgtttttcagttctatcaggttggccacattttttctccagactggctgttttttccgtcagttcctgcaattttttttcctcccttgcattgggttgcaaattacttttgtaactcagtgaagtttgtttctacccatattctgaattctacttctgtcatcttaggccttgctggaaatgtaatttggtcatttggatgaaagaagtcactctggctttttgtgtttttatctttgcactgattgtgtcttatctttgtgggcatatctttgaggttgctgacctttgggcttttttttttttaatcctatttgatggtcttgagtatttgattgtggtataagatggatgcagccaacaggctttgttcctgggaggttttttttgttttgttttgttttgttttgttttgtttggtggtggtggtgggtgggcaatgctcagctcacaactcagaggctgcatactctaactccgggggacttgttttgagccccaactgtgttctctggctccttgagatttggagtttgcgagtttgtgggatgaaggtgccatagctggagcagagtgctagtggatatgggatttctgcctgtctttgggtactcacctcagtggcaggagcaaagcagctgggaagggagtgggggatacctgctggaggctgtgtgctgttgcactaaaggtggtgttggcttggggcaggatactggccagtaaaggttttgatgccttctctgtgccccccaagaaagagtgattgttcagagtgtgggaggttaccctgttctctgcacagtgttagcacaaaggcaggggtggagttttctggctctctgcccaccaaagtttcatctacaatggcagttgctgggggtggcggggcatattgcattcccatttgctggtggggcaagcaaagccaaacctgcctttgcagacatgtgccagcaaagaaatatcaggagttgccatggtgtcacgggaagctgcagtatggggaagaaatgtgggctggtgcagtcataggggctgctttgctggagctcttcatgagtcaggcatgtccctccagtgcagatgctctggtatgagcttccagggtacctgagactgccctgtaagcagctgtggccagactgggtccctgggagaggccagcagaccaaggagtgctcagttggaccagcttcttctgatttgcaagaccatcctgcagaaattaggcccaacagttcccgtagggctaaagtctcttatgggagacagttgagcctagagaaatggccatcactggccacactttactacagatgctcttgcaccaaaccctctggccaccacatgagctggcttgctgcattatctctttgcttgtcttctgggggctgcatctcagagagatgtaggtcagcaattactcagtgcagccagcccaggatggaagatctttacttttggccaagttaggggtttactgtctgctgaggagcagtgggtagtttgtgggacccatggaggatgggctggcttcctctccttgggtaaactgcagtttgaggtgtgaataaggcacttagggtttgggattttttattagtctgagggtagcaaggacagttgtactgcagaggcccctggaggctctgtccagggagttgctaagctgctactggctcaatagctctggcaatgattggctagtggcccgggcctggagaacctgcctcgtgagaatatatgagaacaggcactcacgtaacagtccgaccacttctgaagggctgctgcagtatgctgggtgtccactacagtttctagtcacctcagattttccagtactggaagttatcaccactgaatgctgcaaaacagcaacaatggcagcatgcccttttctctgggagcgccatcccagggaggtatagacctgttgccagcccaaaagcacctgtaggaggtagctggaagcccctgttgaaggtcctacccagtgaggaaaacatgattggggacccacttaagaaagcagtctagccatatttttgcaggacagctctgctattcagaggtaccacttccacccccagtttatttggattctccaaagccagaaggctggaacagctaactcacacaaacagcaaaaatggcagctcactcctccctctaggaactgtatcccaaagaggtttcaaaactccatcaaccaaagagcgctggtggtggtagctggagaccctcattgggaagtactttccagtgagaaggaatgaaacgggggacctgctttaacaggcagtctggccatgtctttttagagcacctgtactgtgctaggagatcctttccgccccccggtcagcttgggctcttcaaagcctgaaggctggaatggctaagttgctcaagcagcaaagatggtggcccactcctctttctggtagctccatcccagggaggtgcagtgctgctaccaatggttggctggaatctaagccagtaggtcttaccacgtgaggcattgttgaagtgggtcctacagaccatcactatcagccccctggattctgcctctttcctatgggtatgttcaggggtgtaacctgctttgctcgagttgcagctactttttctgggaagcctggaaagccagtatctaaggctcttgaatctgcgcaggcctaagtggcttatctgctgagactccatgtagctctgtgtgttaaactgaaggccttggtgaagtgggttcatgagggtatctcctcacctgaaggttgcagagatctgtgggagaatcatgggtttctagggtcacacatgcactcactgctttactgggtggggaggttcccttggctccatgttgttcccaggtggcccattgtcctgccttgctttactccattctccatagattgtttctttgattattcccaatgcaagtacctggatgtttcagttgcaggtgctgtatttatgtataccttgcattcctgtctatgagaactgcacagtctagctgcttctagtcagcaatctcgatcacttttctctaaagggaacctacttttttatattaaaaggattcaatatttttcaaaagcaaatttcaatataatttaactcttacatttgatgctgtgtcttcatttctagaatttatgtgaaagaacatggtcagtggttgcaccagagttgtgagaggttcttctatattagatggacagatttatatacttttccatggaggattaagtaaactgaaacctaagacacacgaagaaattctaagtggaaaggccacttattagtttacagcagtatcgtaagtgacaggatgataggagtgtggtaagtgatcaggataataatctgcttagtaagagaaacaatttgaattttagaaggaaattgccttaccatttgcaaattaaggtaattaaaatacagtgaatttcaaaatgcctttttaatgacaatgtgtgaacttaatttgttttaataaaccaaaattattgttattgtgttaaggctattttacattgaatgtgtatcttgccactgatgttaacttatcccatcttacccaaggttgtaggtaacaatatactattgggtgacagtggactaacatctctagtgatccctttgtcagtggtctttaacttaaaataatttagagaatatggtttctacaacttacatttttgtttacttgtaactacagattattatgatggttgtaatgaagattatgagtataattggagctatatgtttctgaattctgaacaactatttataaaattttatcctacttttttctgttgaacatatgacttctctggtctgctaaacacatacagacctttagttttggtttacatggatttaaatatatagatatatcactgtaaaataaacttcaggtgtaacagatttatagagaaagtaatcatatttgtttatggttgtgtacctactttgagaagaaaagaaaaatattagaatgaacagataattttacaagtgttgatcacttaccagcaaaccagaaacttcagagattttgaaagcaaatctattttctctgctgtgtattaaattcatttatctaaaatgttattgctcctggcttagaatcatcttgtgcaaattctttttttgttgtttgtctgtttgcctgttgctcaccatagacataattttcttttcataaaacattctttgtataatcacctcagagattatgaaagtgactttgataaaatttaatggtgttcacaaaataattttcacgtgagtaatttcacagtgcgtgtattgtatgttatttagtgtattttatattttgtttcaattagagaatgctattgaatccagtttttgtttagttactgttcattttactttataaaattgacataattgagtttattaaatttattgggccaatttaagtaaa

SEQ ID NO: 23691 - DNA, 2098 bp, Homo sapiens
  ENST00000355095
ggtggccaacttgggtgtcttcctctgccagggtcaaggacaaggattgaaacgggtggggcctggagccctagccaatcagtggcgccagcgtgaaactgtccaatcaagtgcgcagctacagaggaagaggcggcctcttcaatatggcggggcctttgtctcctagcttccgggctctgatcctagttcgcgtctccactgttccatctcctccgttcctggagttcctcggtgactctactatagcttctgttatcctgtgacctgcaggtactgggagatccatagggaggacggcggaacatctggaggctgggaaatgggagtgttgacattcagggatgtggctgtagaattctccccagaagagtgggaatgcctggactctgctcagcagcgtttgtatagggatgtgatgttagagaactatggaaacctggtctccttgggtcttgctatctttaagccagacttgatgacctgtctggagcaaagaaaagagccttggaaagtgaagagacaggaggcagtagccaaacacccagctggttcttttcattttactgcagagatattgccggatcatgacataaaagattcatttcaaaaagtgattctgagaaaatatggaagctgtgaccttaataatttacatttaaagaaagactaccaaagtgtgggtaattgcaaggggcagaaaagcagttataatggccttcatcaatgtttgtcagctacccatagcaaaacctgtcaatgtaataaatgtggcagaggttttcagttgtgctcaatcttcactgaacataaagacatttttagcagagagaaatgccacaaatgtgaagaatgtggcaaagactgtaggttgttctcagattttactagacataagaaaattcatactgtagagagatgctacaaatgtgaagaatgtggcaaagcgtttaaaaagttttcaaaccttactgaacataagagagttcatactggagagaaaccttacaaatgtgaaggatgtggcaaaacttttacctgctcctcaacccttgttaaacacaagagaaatcatactggagacagaccctacaaatgtgaagaatgtggcaaagcctttaagtgcttctcagaccttactaatcataagagaattcatactggagagaaaccctacaaatgtgaagaatgtaacaaagcctataggtggttctcagaccttgctaaacataagataattcatactggagacaaaccctacacatgtaatgaatgtggaaaagcttttaagtggttctcggcccttagtaaacataagagaattcatactggagagaaaccctacatctgtgaagaatgtggcaaagcctttacccgctcctcaaccctttttaaccacaagagaattcatatggaagagagaccttacaaatgtgaagaatgcagcaaaacctttaagtgcttctcagacctgactaatcataagagaattcacactggagagaaaccctacaaatgtgaagaatgtggcaaagcatcgagctggttctcacacctcatcagacataagagaattcatactagagagaagctccacaagtgttaaaaatgtggaaaagcctttaccaagtcctcatactgtgttcaacatctgaaatttaatactgaacaaatgcagtataaatgtaatgacagtggaagaacatttatcatcttagagggtctctaagaacttactttataatctggttgcttatatgttgggtacatatatagccctttgctattatgtaatgccctttttttttaaatctatgttaatttcaagtctgttttgtcagaaactaggattgcaacccctgcttcttttcctgttttctatttgcttggtaggcttttctttttccctttattttgagcttatttgagatgggtgtcttgattaaagcataccattagatcttgattcttttttcagcttgccatctgtgctttaatttgggtatttagcccatttacatttaaggttagtattcatatgtgtggattggattctgttattaggatcttagctggctattttgcacatttgtttctg

SEQ ID NO: 23692 - DNA, 3501 bp, Homo sapiens
  ENST00000543758
aatgcttgcaggtggcccgttcttcctctttgtccttcgctgccacgtgagaggggagtgtacgcgtgtgcgcgcgtgcgagtgtgcgcgtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagaca

SEQ ID NO: 23693 - DNA, 3237 bp, Homo sapiens
  ENST00000539354
gtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtctttttccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagaca

SEQ ID NO: 23694 - DNA, 559 bp, Homo sapiens
  ENST00000438628
gcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttgtgagttcatccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggag

SEQ ID NO: 23695 - DNA, 960 bp, Homo sapiens
  ENST00000540031
ggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctg

SEQ ID NO: 23696 - DNA, 598 bp, Homo sapiens
  ENST00000539098
gaggccgcgggcgcgcgggcgcgactcggcggcggcgtctttttccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactgggtaataaaagctttcttgaggaccttggactatgcccaatgcattgccttttatttttagttgctgggaagtttcagaagcctatagctaggcttctgaaatttttaatgattttagacctgaaacttagatcacagttgcttggactatgacaccaagaaagtatttgggtctcacctttcaataatgaagttgtaagtttgtcatgcagcctctgaaactt

SEQ ID NO: 23697 - DNA, 637 bp, Homo sapiens
  ENST00000539686
gactcggcggcggcgtcttttgtgagttcatccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactgggtaataaaagctttcttgaggaccttggactatgcccaatgcattgccttttatttttagttgctgggaagtttcagaagcctatagctaggcttctgaaatttttaatgattttagacctgaaacttagatcacagttgcttggactatgacaccaagaaagtatttgggtctcacctttcaataatgaagttgtaagtttgtcatgcagcctctgaaacttaagtagtaatagtttgagcagtagtgatagcacctaatgcatataacttact

SEQ ID NO: 23698 - DNA, 558 bp, Homo sapiens
  ENST00000536123
ggcggcggcgtcttttgtgagttcaagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagat

SEQ ID NO: 23699 - DNA, 7162 bp, Homo sapiens
  ENST00000327668
gggggctccgggaatggcgggggaggcgcgcgggagtggccgcggggagcttcggcttcaaggccctgggcgtccgcgcgcggatgcgggtctggggcgggttggggctgggccgggtcgtgaagatgccgtgggccgcggagctgcgcggattctgggctgtggggcgggcacggcctttccggaggcgccgctcctgggcgtcctttcaggcgggcgtggaggcgccagcctcgggcgcgtttagcctcgggcgcgtttagcctcgacctcgggccagcccgcttgccgcgccgtggccctaaggagcggctgccctgctggaccgcatccaccagcagcctggctctgccgctatcgaaggaggcttttaaagcgctggggttacagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtatgaacttcctggctgggcacagtggctcatgcctgtaatcccagcactttgggaggctgaggacctcaagtggagacctcaagtggatcacttgaggtcaggagttgaagaccagcatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcagttaaacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtatcaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgctt

SEQ ID NO: 23700 - DNA, 562 bp, Homo sapiens
  ENST00000543310
aaataaggttattgacctggaaagatgttcttcacataatgggaaaaaaacaaaaacagcttttaaatatgaccatatgcttccattgtatgaaaaatatcacaatagtttccatcatcctaagaatggttacctgtgtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattct

SEQ ID NO: 23701 - DNA, 546 bp, Homo sapiens
  ENST00000545299
gacctggaaagatgttcttcacataatgggaaaaaaacaaaaacagcttttaaatatgaccatatgcttccattgtatgaaaaatatcacaatagtttccatcatcctaagaatggttacctgtggtgagatcatagataatagttcttatttagcttgtagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggtg

SEQ ID NO: 23702 - DNA, 1451 bp, Homo sapiens
  ENST00000542358
ggaggcacacaaacctgtagttccagctacgtgggaggctgaggcaggaggatcccttgagcctggagttcaaagttgcagtgagctctgattgtgccactgcatgccagcctgggttagggagcaagaccgtaccaaaaaaaaaaaaaaaaaaaaagaatgctgatgttgcagacttcatctaagataaaatagattttaaggcaaaaagcattattgggggtatgaagcgttgttacacaatgattttttaaaacccctatttaaccttgacgcatcaaacaacatagccataagcatataatccaaacatcagcagaattataaggaaaaactgaccaatctctagtcatattgtgagattttaacccatttccttctgaaatgggtagacaaaaatggcagacaaaagttaaggatatattaatagaagattttaataggaaattaggctcagaatggtgaaatttgtttgtttttgccaaaagtcatctagctggtaaaggaaaaagttgattgaaactcaaatctgttttaatacagatcatataaactgtgtttttcctaacagcacctgttaaactgatttgcatttcagcattcacagtgaatattgagtgaatctcacaattactttatttctgatatttccttatctgtttgcagagacctaggcttccactgttccattttactatattctgtttccctgagagtgctgtttcagttatatagcaagcgtacctctggccttagatgatcgtgaattccaagttcctagcaagagagaaagagatttcatgtgcaatgtgaatataccagttgaagtacatttctcccgaagtccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactgggtaataaaagctttcttgaggaccttggactatgcccaatgcattgccttttatttttagttgctgggaagtttcagaagcctatagctaggcttctgaaatttttaatgattttagacctgaaacttagatcacagttgcttggactatgacaccaagaaagtatttgggtctcacctttcaataatgaagttgtaagtttgtcatgcagcctctgaaacttaagtagtaatagtttgagcagtagtgatagcacctaatgcatataacttact

SEQ ID NO: 23703 - DNA, 436 bp, Homo sapiens
  ENST00000441040
tccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacagatttaccaggattgtgctcttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattcc

SEQ ID NO: 23704 - DNA, 540 bp, Homo sapiens
  ENST00000542874
tccacagatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagggacctccatagtatgacactactgctgcctgttcagttatttcttcctatctcccattcatgaagtctggaaagtagatggtaacatgatgtggcaccaggataaccaaga

SEQ ID NO: 23705 - DNA, 647 bp, Homo sapiens
  ENST00000535439
atcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttcatctgg

SEQ ID NO: 23706 - DNA, 1607 bp, Homo sapiens
  ENST00000543124
ccgtactggctgtagacaccttcgtctttctttacctccctggatacacatgtagtttactatggcacctgtcttctcatggcagtactctgttcccaaacaaacatcattttcttctggagaggctctctttaatctttaggttaacagttgtataaatggaaggatggaagaatgcacaatgacattttatcacacaaaatatgcaaaggtagagacatagtaggcattttgtataacttgttatgagaatgaagtgctaaagctccaatatttttttctcacatcatacggtgttaactgcttcagatttaccaggattgtgctcttacaggagtcattctcatttgacgatttatctgtggacttcacccaaaaggagtggcagctactggatccctctcagaagaatttatacaaggatgtgatgttggagaactatagcagcctagtgtcactgggtaataaaagctttcttgaggaccttggactatgcccaatgcattgccttttatttttagttgctgggaagtttcagaagcctatagctaggcttctgaaatttttaatgattttagacctgaaacttagatcacagttgcttggactatgacaccaagaaagtatttgggtctcacctttcaataatgaagttgtaagtttgtcatgcagcctctgaaacttaagtagtaatagtttgagcagtagtgatagcacctaatgcatataacttactatatgccacatcttataccaagtgctttacgtatatcaactcatttagtcatcagagcaatcctatgtggcaagtacagtcattatccatttttcctgatgagaagatcgaggccaagagaggttaagtaactttcccaagaactaacagctagtaaattaaagagcctggatgtaaacccaggcttactggctccagagcctctgaagtgttcagtggctttgtactagaccctattagccaccaagggagaccgttactgtaactttgagaattacttactctgttggggtacagcttcaccaggccaactttgatgtgaaaccttgctcaactttagaggccctaaaccccaagcagttgggcccaaggcctttgtgatttttcccttaacagggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaact

SEQ ID NO: 23707 - DNA, 7020 bp, Homo sapiens
  ENST00000392319
actcttggtaatgcttgcaggtggcccgttcttcctctttgtccttcgctgccacgtgagaggggagtgtacgcgtgtgcgcgcgtgcgagtgtgcgcgtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtttgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaacgagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtatgaacttcctggctgggcacagtggctcatgcctgtaatcccagcactttgggaggctgaggacctcaagtggagacctcaagtggatcacttgaggtcaggagttgaagaccagcatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcagttaaacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtatcaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttc

SEQ ID NO: 23708 - DNA, 15455 bp, Homo sapiens
  ENST00000537226
gttcaggccacgctccgcccccagcccgtcagccgcgcgccccgggaccctagagccggcgattcgtcgccggcgccgcagccgccactctgtgccggaccctgcgggccttcggcccagagcgcgtccgtgacgcacagaccaggcccctctgcggggcggcgcaggagctcctgggaaacgtagttcggcctcgcgtccccctcgggcgggaccgcggacgcctggaggcaggcactgaggacggggagaacttcgggtgaaatgcatccctcctgtgactggattggagacacaagaacagaaacatcctgatctctctactctactgtgcaggcttatgtactcataaaatggcagttatggacctatcctccccatgggctttaactaaacaggactctgcctgtttccatctgagaaatgctgaagaggaaaggatgattgctgtatttctgacaacctggttacaggaaccaatgactttcaaagatgtagctgtggagttcactcaggaggagtggatgatgctggattctgctcaaagaagtctgtacagagatgtgatgttggaaaactatagaaatctcacctccgtggaatatcagttgtacaggcttactgtgatctccccattggatcaagaagagataaggaatatgaaaaagagaattccccaagccatctgtccagaccagaagattcaacctaaaaccaaagaatcaactgtgcagaaaattttgtgggaggaaccatccaatgcagtgaaaatgataaaactcacaatgcataattggtcctccacattaagagaagactgggaatgccataagatcagaaaacagcataagattccagggggacattggaggcaaatgatatatgccccaaagaaaacagtacctcaggagctattccgtgactatcatgaattagaggaaaactctaaacttggatcaaaacttattttttcacagagcattttcaccagtaaacattgccaaaaatgttactcagagattggatgtttgaaacacaattcaatcataaacaattatgtgaaaaactctataagtgagaagctctatgaaagtcatgaatgtgatacaactctatggcattttcagagaaatcaaacagtacaaaaagagtacacatattctaaacatggaatgcacttcacacataatatgtttcctgtacctaacaatttgcatatggcacagaatgcctgtgaatgtaataaagatgaaacgctgtgtcatcaatcatcccttaagaaacaaggacaaactcatactgaaaagaaacatgaatgcaatcaatgtggaaaagccttcaaaaggatttctaatcttactttatacaagaaaagtcacatgggtgagaaacaatatgaatgtaaagaatgtggtaaagtgttcaatgattcctcaaccttaaggagacatgtaagaactcacactggagagaaaccctatgaatgtaatcaatgtggaaaagctttcagtcaaaaaacatcccttaaggctcacatgagaactcacactggagagaaaccttatgaatgtaatcagtgtggaaaatcctttggcacaagctcttaccttatagtgcacaagagaatacacactggagaaaaactctatgaatgcagtgagtgtggaaaagccttcaacacgagctctcaccttaaagttcataagaaaattcataccggagagaatgtttatgaatgcagtgactgtgggaaagttttcagtggggtctcatcccttagaatgcatataagaactcacactggagagaaaccctatgaatgtaaggaatgtaggaaagccttcagtgtttcctcttcccttaggaggcatgtgagaattcacactggagagaaaccctatgaatgtattcaatgtggaaaagccttcagtcagagctcttcacttattatacacaagagaattcatactgagagagaaaccctgtaagtgttatgaatgtggaattgctgttttcattgtcttaaggtggattccaagctccttgtctcagtctttgttctctaaaagaacgatttaaggttacaaatggctctttttttaatataacattttctgtaaatactaattatgactttttttgatccatggctgtttagaattaggtatttttaatatgtgaggtaggtatattttcagttatctttttattgttggtttctaggttaattccattgtgttcagagaatctggactatattttactgctttgttggtgtttttataaaagttgttttctggcccagtgagactggtattgctagcagccaaccaaacatttgagctcatctttccttactaatgaattccatcttagccaagaacaataaggtctctggttatagaacgcttctttgacttcttgtagctaagggtagccatatcattcattcttgctgattcaaaaatagacatatcactgggatcagaactatctatcttgtcctctactttttgcacttcatctttgtccctatgaattggccattcctgaagctgctgaaagagctatcttgtgatcatgaaaatgacagctgtagccaagggatgaagtagaagaaagagatccctgttcctcaaagaaatctttaaatagttgtaccagccctgcactacttgtatctggatatgttcctacatgagaaaaataaggttttttgtttgttttttgagatggagtctcggtatgttgcccaggctggagtgcagtggcacaatctcagctcactgcaacctccacctcccaggttcaggtgattctcctgcctcagcctcctgagtagctgggattacaggcaccaccgccatgcctggctaattttagtatttttaatagagacggggtttcaccatgttggccaggttggtctcaaactcctgacctcaggtgatccacccacctaggcgtcccaaagtgttggcattacaggcgtgagccactgtgcccggccaagaaaaatatgttaattgattttttctttttttttttcaatttttcagacagagtctctgtctctcaggctagaatgcagtggtgtggtcatggctcattgcaacctcgacctcctgggctcaggtgatccaccacagtctcctcagtagttgggatcacaaatgcatgccaccatgcctggctaattttaaaaatatatattttgtagagacaggctcttcctacattgctcagactggtctgaaactcctgggctcaagcagtcctcctgcctttgcctcccaaagtgctaggattccaggcatgagttaccatgcctggctcttactgattttttttaaagcactacataaatacagtcaacgcagtcaccatattgtagaaaaacagaagtatatacagttaaatgttttatgttggatgtacacatttgaagaggaacatagaaaaaaagtatggaaaaggaatgttgaccgagcttttatgcttaagcagcagatgaagatagaaccaagatcactgaaagcaagtgtttagaacagcaaaaagagtatcccaacatttcagcattggaactacagaaagttttcagacagaggggaagttaccaattttaaatgctaagtaaagcatgagattttgctgcttgatcttgcagatactgaccagattagttctaacaaaatatggaaggagtggcatacggtggaagaaagaaggcagtagctgctgttgtagttattcatgttagcctcagaggatggtgagacatccagatgaagaggttggtacgcaattctagaattgaggaggtgtctagatagagatataaattgtagtgacatcagtaaagagacaataacaggctttggaaggtgagtaagaatgaaaagggaaggtctgccacctaccctgaagacatacatttaaaggaactatagtagagagataagaggaaaacaagaagagtggagtttcactgaaccaagacaaacaagtttcaaaaaggaaggtgaagttggccaggtgtggtggttcacgcctgtaatcctggcactttgagaggctgaggcaggcggatcacaaggtcagatcgagaccatcctggccaacatggtgaaaccctggttctactaaaatacaaaaattagccgggtgtggtggcacatgcctgtagtcccagctactcaggagctgaggcagaagaatcacttgaacctgggaggcagaggttgcagtgagatgagatctcaccactgcactccagcctggtgacagagcaggacttcatctcaaaaaaaaaaaaaaaaaaaggaaggtgaaggtaaatgtttttagtgttacttagggatccaattagatgaagtctaaaaaggtaaacatatacagccaagtgaagatcatttgtgattgtagttggaaataacatagtggtacataatgaagatggttgctagattgggctgactttaggaatcaataaagggcaaagaagtaaagactggatgtagacaagtttgaataataggagaaagggtagtagctggagagatttggagtaaagagataatatgtttaaaatatgaaaaactagaacatgtttgaattctaatgtgatgaatgtagtatggtgaggtttaatatgcagcataataaagtttaatataagcttctgagaatggggtgtagatgtttagagcacaaacaaaagtattggtgtttgccatgaggcggagggatactcccaccattctttcaggagtagaaaaatgggtgggttggtttaaattacttgtttatttatttacacctaactgtactaagcagtgatcagaatatgtgaactatataatgttttgtgtttcctaagaactgtgtggcagccactgctaattactaaccaaatatatatattttttattctttatgaatagatcttcagttttgctaacagtagtattgtatttagctacaaaactacttatcccaacctctttgtagccttgatgccatttctactgttcctggccagtaaaatatagatatatgattataggtttcatggtaagattatctgctaagaggaaggtggatgaaattctgcaaggaggttttagtgaagaagatctctatgtatttgaaagtccttccaagttatcaatagagccatcagtggagaagacagcaaagcaagtagcaaagtctatgtgattgaggagaggtcatttaaataaaagatagcaaggaagagagggagaaagtggtataactagatggtatgaacttcaaaggaaggagtggttttctccaggctgcaatggttagaagcagtgttagggagtaaggaagatactgatcccacttccaacctgtggatatgtggaatacatgagaataagcccccttgtgatgtgattgttgtcaggtaggtgttttttccttcccagggaacagccaagtttaaattaatgaaaggaaatgttcagggaaatagttgaggatattaagggagtttattaagggaatctcagagggcaccatgaaagagtctccagaagggcaggggtttagggtttctggctttggcctgaggaatacagaagattgtaatgacattattgatagaggaaaaaagaccagatcaggggctatgaccagtgaaaacaaaatttagagggagtataggttaaatcccagcagtctgtaagaagatgatgggtatttaggtctactgggattcatttgtagcttggaaaggagagcctgcagtcatgctgtgaaaccaagtggtttcaggtgttagcagccctggtgggtatagcactagccatcagtagttagaaaatggtcccaactggccgggtgcagtggctcacgcttctaatcccagcactttgggaggccgaggcaggcggatcacgaggtcaggagattgagaccatcctggctaacatgatgaaacctcgtctctactaaaaatacaaaaaattagccaagtgtggtggtgggcgcctgtagtaccagctactcgggaggctgaggcaggagaatgctgtgaacccgggaggcagaggttgtggtaagccgagatcgcaccactgcattccggcctaggtgacagagcaagactccgtctcaagaaaatcgtcccaactgcatgtggtccttgggtgagatcatcttaaggagtactcagcaagggattgtactttgcttggttaggactggaatttacactctaattttggcccagtgatcttggaacagattgagcatctcaaatctgaaaatctgaaattcagaatgctccaaaacctgaaaccttgtgcgccgatgtgactttcaaaagaaatgctcattggagcatttaaaattttggattttcagatttgtgatgctcaactagtaggtataatgcaaatattccaaaatccaaaacagttctggtcccaagtgttttgaataaggaatactcatcctgtacaccaggaggtagactcaggcacagtctcgcccagcatctcacctggattttattgcaatagcctcctaactggtttctctgacttgaatcatactttcctttagtatgttttctatgcagctgccatggtatcctattaaaaaacaaaacaaaacaaaacaaaaactttgtggtttttaataataaaactaatacatgcataggagaaaacaatgtaaataacttctgccctacacagaaggaaaccctggattctactgccttaaaaaattaatatcgtaggtgaatgtgcattctgtcagactttatgtacatacaaacattttataaaaattgagttataccttttatcccacatcttttttttttttttttttttttttttgagaaggagttttgctttttcccaggctggagtgcagtggcacgttctcggctcacagcaacctctgcctcctgggttcaagcaattctcctgcctcagcctcccaagtagctgggattacaggcatgtgccaccactcctggctaattttgtatttttagtagagacagggtttctccatgttggtcaggctggtctcaaactcctaacctcaggtgatccgcctgcctcagcctcccaaattgttgggattgtgaggccatcgcccccagcctatccaacatctttttaaacatctttccatgtcagtgcatgtagttctatttcatttgtaatagctgcttagtatttgattatatgcttgtaccataatgtatttgatccatttgcctccagagtttttataacaatactgcaatcaataatattgtttatatattgtgctttcctatcaactgttctctacacttcccagggtgatccatctaaagtactaacctgatcacataacatttcacgtttaatcttcttctggcctttttctccagttaagataaaatctttttacaagaccttgctcaaactcttgccttttcaggccttatctctggttattccctttatcttcactgtctccctaatttaacctgtcctatttatcctttaggtattgtgtccttcatctgctttaacaatacttgtcacactttcacactgtattgcctgtttgtgtattgtgccctctacactgtaagttttggtaaggtgggaactttgtctaaatttttcattgttttattacttggcccagtgtaggtgttcagttaaatatttacggttcttcagcaaattttgtgccttttcttttacttaccattctagtggaagtttaacttaaaagctatttaagtgattgtaaggtaaaagttgcaaggaggtgggtgcaatggcctgtgcctgtagtcctatctgctctggaggctgacgtgggaggattgcttgagcccaggagtttgagaccagcctgagtaacatgagactccattatagtaaaaatgcatggaattaatttttcttctaggtataggaaaatgttgcaccataacaggtgtgcagaaactaagactgttaggacaacagcagtttaatgttatttatattatgtccctctcctagtccttctcctctcttccctcatcccactcaccaccaccccattcactacacagacttattttttgtagagcaagtgttcatattctgttccattatgtattataatatgaaaagggatgagttgaccaagtattggtgggtgtgtcgtatacttgctttagactaccaatggaagcgtaaattagtacaaacttactgggtgggtgtggtggctcacatctgtaatcccagcactttgagaggctgaggtgagtagattgcttgagcccaggagtttgaaaccagcctaggcaacatggcaaaaccccatctctaccaaaaaaaaaaaattacccatggtgtcatgaatctgtggtcccagccactagggatgctggggtaggaggatcacttgagctgcagtggggttgagtctgcagtgagctgtgtgcaccactgcactccagcctgggtgacagagtaagaccctgtctaaaaacaaaaacaaaccaaaaaaaacttgggacagtaaagcaataaatgtccaaagctggaatatttataacctttaaatatttaaaacccagcaattttaaactgagattttataaaaggatttttcatgtataagtaacaatattcacctgtttcatgccctagtgaaaaactggaaaattcctaaattcccagtaacagtcaataaaatggaatataatgcagtcattaaaatgtatttgtgtggattgacatgtggagatatatttgatacattatgaattttaaacagtcacaaaatatggtatgactttttaatgcatgttataaatatgtgtgtgtgcattgaaaatatggaaagacataacaccaaagttttatcaatggttatgtcataatttttttcttttgtctttttttaagatgtctagtttagtgaacagagctgtggtctatttcttaaaaataattctatcattaactttttaataaatactttttaaagcatgattttaatatcttcaaagttgtaaagtaaataatttgcttaggctgttgttggacacatagattcttttcatttttttaaataccagattaaaaaaattgaaaaatatatttttttatattttataaatatatttttaataaataaatataaatatatatatatatattttttgagacagagtcttgctctgtcgcccaggctgtagtgcagtggcacgatctctgctcaccgcaagctccacctcctgggttcatgccattctcctgcctcagcctcccgagtagctgggactacaggcgcacgccaccatgcccagctaattttttgtatttttagtagagacagggtttcaccgtattagccaggatggtctcgatctcctgacctcgtgatctgcccgtctcggcctcccaaagtgctggggaaaatatattttttaacttaccatttctatctcctactttttaaaggcaaactttttgaaagtgttgataaagggtgtggatactttttagacttcctcttactctaggcagaattcaaaatatgaaggatacaaataagtttctctgataagaacagggaattgtgttagaaaaagcagtcagggctaggcgcagtggcgcacgcctgtaatcccagtgttttcgggaggcagaggtgggtggattgcctgagctcaagagttcaagaccagcctgggcaacatggtgaaaccccatgtctactaaaaatacaaaaactagctgggcgtggtggcacacacctgtagtcccagctactgggaggctgaggcaggagaatcacttgaacccaggaggcggaggttgcagtgagccaagatagtgccactgcactccagcctgggtgacagagcaagactgtgtctcaaaaaaaaaaaagaaggtctccatgagaaaataacatttaacttgaaatacgaagttaaagaaggagtagggagctccttcttctggctccatgggcagagggtggagggacagaggaagagctttctaaatagaacagcaagagcaaaaagactcatcaggatttgacatatttgtggaacagaaagtaagtccagtaaatggaaaactgttaggcaaaggggtaaggagaagagtatgtgaaaccagattgaaaggaggcaggggccagataaagaccttgctagctatgacatgagtttatactttatttgaagagttatgaggaactatttaagtttttcagagattgaaattatttgttttaaaaagatcacatttttgtataaaaaaatcttgagagactaggaagctatttgcaatagttcatgtatgaaatttgaatgccaaaaactaatttccttagcattcacttttttatttatttttctttattttttaattttctgtaagttactgggtttcctttttaatttttccataagttgcattcactttttaaaagacaatgagatttgttttagcataaacaggaaattcatggctaatacatgtcatgacttaaattcacctctaacttaagaaatgcatgtcaaatacataaaattatattttctacctatgagcacagtttcatgggagttttgatttttctaaaatattttttgatgcaatatccatttttttccatgcaattttgtcctttgtgatattgagggtgttcatgatgcagaatttattttaaaaaattatttctgtaatatttatttctccctttttttgagacagtgtctcactcttgcccagactggagtgtagtggcacaatctcagctcactgccacctcaaccttctgggctcatgtgatcctcctacctcagcctcctcagttgtggggaccacaggcatgtgctattacacctggataatttttttatttgtattttttgtagaaatggggtctcactgcattgcccaggctggtatcaaactcctgggctcaagcaatctttctgccttggcctcccaaagtgctgggttacataatttatttttttttgttttgtttccttaaaagaattgttaacataccagataattttttacactttttgccactttttctatgtcctgccttttaaaggcagactttttgaatgagttgctaaggactcagactctttcttccaaatcaatcatacccaataggcaggttttgctacctctctttgctctgaaatttcttggatctcttcagagggatttaacaaatttcctgtcctttttctcttttctttttcttttgttggttttgttttgttttgttgagatggaatcttgctttgtcgcccaggctggaatacagtagcgtgatctcggctcactgcaacctccacctcctgggttcaagtgattctccatgcctcagcctccatgagtagcttggattacaggcatgcaccgccacacccaactaattttttgtatttttagtagcaatggggtttcaccatgttggccaggctgattttaaactcttgacctcaagtgatctgcctgcctcagcctcccatgctgggatcatgctgggattacaggcacaagtcacttagccccctgccttacatacattgatgtatgatagaaaattcttttgggcacatcacagcaacaaaagttaacccagctttacctatttgtgagtatcttaagtctcccaaagcatttgattgttgctttccaagaaaatacagaattgtggtcattctcccatgactattctttactaatattgattgcatctgttgttctgtcgcctttctgcattcatagtaacttctttttccaatgctgaagattagttttaataaccttttgggagacttcttttaaaaaacttttttttcctgaagaataatacataaaggcatgcagctttatgaatttccccaaatagaacacacttaaccagtccccagatcatgagagccaaattaatacttttactacttttgcaatattcctagactcatcttttaaacgtctccctcctttcttgtgctattgtcgtgctatttacttcggtgtattttataatccaccagatattgttatgaaagtaaatatttatatcagagttgacaaactttgtctgaaggtcctgagagtaaataaatattctaggttttctttttttttgagacggagtctcgctctgtcacccaggctggagtacagtggcgcaatctcagctcactgcaagctccgcctcccaggttcacgccattcttctgcttcagcctctcaagcagctgggactacaggcgtctgccaccacgcccggccaatattctaggttttgcaggccatatatggtaactgttgcatattcttatttttctaagcagctttttaaagatgttaaaatcattcttagctcaaaggccttgatttggtccatagaccataatttcccaacacctgacttgtatttatcaacatatttacccctccagtgttatttatttctgcatttccaagtttctaagatcatttcatactgcctgaaaaattatttcttttagcataagaatgctaccgtaaatttcctctatttttattctgaaacatctttatttctgaaggatattttagctcagtatgaaaagaggttagcagtttttcacagtgtacatatgagccccccgtcccccactgcaatagtttttcttaaagggacctgcctctcccttagttgagaatatttaagtgaacttgagaatatttaagtgaactggcttcaaccatatgtcaagtagtatgtttgtgggctatcaatttatttctaggaaccctatgatcatttagccattgccacctatatggttaaaattctcattaacagtgcatcccttggactcttgtgcagattttacccaacccctcccatgccaagatcctatgatctctactgaaattgggatcttactttcattatagaagttctgcatcatctacagtctagagagggtgggtaccacagagttgtccaaggatggtggtaaactcctcaccaatgtatttcttaataccctgacgggaatgtcttttggcctttctctggctaagggaaaaaatgaacataataattcattgatagttacatctccctctaaagcagaggtgtccaatcttttggcttccctgggctacaccagaagaagaattttcttgagccacaataactgatagctatcattagtgttcacgtattttatatgtggcccaagacaattcttccaatgtggcccagggatgccaaaagattggacactggattccatccagtatgacttttcagatatctaagaagattttgctacacttattacaatggtagttttcccacagtgtaattctctgatataggtttgaaatattgcagaaattcactctacattcatttatacagttgctttttctcctacaagagtattaaaatttaagtattgcattgtaattgaaggcattcccaaatcactgtgtttgtatcactttggttaattggagattgctccaaagtaaacgttctcaatgttggctgcactcaacaaaaactagagggcaaagatttgatgtagtcaggggttggccaagtttttctgtaaagggctagatagtaaatgtttaacctttatggctgtatattaaactcttcagttatagaggtaaggagccatagactatgtaaatgaatacctggcccatgggctgtagcttgatgacctctgatatagttcatgaggtgcatccccacagagtaaacagtaggaaggaaagtggatgtggagcagataatgggagaaattgagtatactcttaaataaataaataatgaatttttcatatcctaattttgctgacagggtaacttgatttttaccctgatacaaaccattcctgcctgagaaaaccaaatcagatactagatacccatatgtaataaggcatgctgcttgaggacaccaaatcagatattaaatacccatatgtaataaggcatgctgcttgagaaaatcaaatcagatattagatacccatacgtagtaaggcatgctgcttgtattcgagtcagactgtacactattgtaagataaatcagcctctctgaaacaactcttatggaaacttgagaagcttctaaatgtatgtaccaatatggcatgccaatggcaggtttgaggaaatacacttctgataatgtatttagaactctagtacatgtaaataaggtgtttttgggctaaaacttttataaatttcacctcttacaaaattacttatatttatctaataacacctcctacaaatgtgccctcaatgcagccattacattaatgctcactaaattcattcctattcatattctctacctctctttctacaaaataaaattgcttaccttcctgattaaggcaaactaaccctgatggtgtgacctttgtcagctgggcaggtggtaatgccagaacagttttaaatacctgcttacaaaagaacggttttcaccgtacatggaacaaaacaggaagaataccttggtaattttctgtgatgtatcttatatttgtttcacactgaataacaaatgtctatagtcagattcaaggataactgtcagcattaccttaaatccaaactctgtctgaaagttaaaatcataaaacacctaaaaacactttgttatgtttgtatgtttcaacaagaaaaactactgtttattttttatgtcaatattgtagttacattttcagaatcacatgctgtgggaaaaaatcagcaagcagaaggtttataataaaccaaaagatttatttataacattttctgaattcacttaaaaaacaaaaaggaatcccccttccctcaaaatagaaccgtttcctacagattccatccagtatgacttttcagatatctaaggagattttgctacacttattacaatggtagttttcccacagtgtaattctctgatataggtttgaaatattgcagaaagtcactctacattcatttatacagttgctttttctcctacaagagtattaaaatgtaagtattgcattgtaaatgaaggcattcccaaatcactgtgtttgtatcactttgcttaaatatgaattttctgatctccaaagtgcatcatctttgtaaagctcatcccttgtccatgctttctgtcctggttgacagatgcggaatgagggctaatctctggctttctccaatctattggatatgtattctttcctggtaggaatttacacacgtaaagtaagggactcctaccaaatgaagtcttctcaacattaccagatggaagaatcttctcaacaatattgatttcaccttgttattgcaaaaaaataaaagagtggttattaatggcttttccacata

SEQ ID NO: 23709 - DNA, 1225 bp, Homo sapiens
  ENST00000305105
gagagtgcgggcggaagacggggagagcgagaggctggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaa

SEQ ID NO: 23710 - DNA, 571 bp, Homo sapiens
  ENST00000461205
gcagtttcttccgacagttgtgttgtgccaatggtggagaagaaaacttcgggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatcccc

SEQ ID NO: 23711 - DNA, 3958 bp, Homo sapiens
  ENST00000492315
agttgtgttgtgccaatggtggagaagaaaacttcgggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccaggttggtctccaactcttggcctcaaagcgatcctcctgcgtgggccttccaaagtgctgggattacaggcgtgagctgccgcgcccggccccagctattcctcgtaaatcccttcctcagccctcgggtcctggcgttgacccttcattcacgttttattggtgcctgctccaagccgggcgctggggatgaagaggagaaagacccctcttatccaagcattggctttttctggaaggggggcagaaacgcagacctaacactgtattttactgtgatttgtgatttgtgctatggcagagggaagcacagcgcctgggaacagggagacgtggcatctagcccaggttctgggaggcaggggactgtgaaagcttgaaggaaaaatgaaaaagcttgaattgagtcttgaaagtctagttagggtttctctcagtgggaacctcacgtgcaaaggcagtgaagcaagaaaaagcaagtcgcttaggaagccaagttcacagtttggatcttacagagtaataagaaaggatcgaaggctggggaaaggttacattttgaaaggcattatacacactgcccaggagtttgaactctgtagggaaacactggagagccagcaaagactttttttttttagacagagtcttgctctgtcacccaggctggaatgcagtggttctatataactcactgcagcctcaacctcccatgctcaagtgattcttccacctcagccacctgagtaggtggaactacaggtgggtgcaggccaccatgctgggctagtttttatattttttgttgagatgggtgtctcactatgttgcccaggctggtcttgaactcctgagctcatgtgatcctcctgcctcggccttccaaaatgctaggattacaagtatgagccactgcgcttggcccttttagtttttctttctttctttttttttctttttgagacggagtcttgctctgtcccccaggctggagtgcagtggcgcaatctcggttcactgcaagctctgcctcccgggttcacaccattctctggcctcagcttctggagtagctgggactacaggcgcccgccaccacacccagcttatcttttgtatttttagtagagacagggtttcaccatgttagccaggatggtcttgatctcctgacctcgtgatccacccgcctcggccccccaaaatgctagaattacaggcatgagccactgcgcttggccctctcagtttttcaaaggcatcgcagtctcccagccatcagttttttcatgttggcctcaaggtctgaaataccccgctgtctcccctagccaggtcattcaccagttaggccttaacctagacttaccttcttctgggaagtcttccctgactactccaaggccaggttgggtgtttctgtcctgggctctgcagcactttatacttccgtatcctagcctactccatgctgtacttactgtgtttgtttcattaatcatttgtgtttgccactggactgtaagctttggcatccctaaaacctagagcactgcctggcatttggaggggagacagagtagtacagtgatcataatcatatttttttttgtttggttggttttgggtttttttttttttttttttttttttgaaacagggtcttgctctgtcacccaggctggagtgcagtggcacaaacacagctcactgcagccttgagctcctgggctcaagcaatccttgcgcctcagcctcctgaatagctgggactacaggtgtgtcccactacacctggctaatttttgtattttttttgtagaaacatggttttgccatgttgcccaggctggcctcgaactcccgcgctcaaacaatccacccaccttggcctcccaaagtgctgagataacaggcatgagccactgcgcctggcaaggtcatgctttttgatgctgggtagttctttgactcctgacctggccacttgttagctatgtgaactttggacacatttcttaatctctgaatgttggtaaattggggatgatgatactgtcccatacagctgttgtaagggttaaatggttcaagtgttgcaaagagctgagcacgtgcctggctcatagtaagtgtccaacaagtgatagctactggggctgctgctgttattattatgcttaacaggtggttaatgaataaagagatatattatgcaaaattatcagaatctggcaaacagctgataaggcaatgaggaaagaggttttttgttttttgtttttgagacagggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttttgagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtga

SEQ ID NO: 23712 - DNA, 2898 bp, Homo sapiens
  ENST00000485387
caaagtgctgagataacaggcatgagccactgcgcctggcaaggtcatgctttttgatgctgggtagttctttgactcctgacctggccacttgttagctatgtgaactttggacacatttcttaatctctgaatgttggtaaattggggatgatgatactgtcccatacagctgttgtaagggttaaatggttcaagtgttgcaaagagctgagcacgtgcctggctcatagtaagtgtccaacaagtgatagctactggggctgctgctgttattattatgcttaacaggtggttaatgaataaagagatatattatgcaaaattatcagaatctggcaaacagctgataaggcaatgaggaaagaggttttttgttttttgtttttgagacagggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttttgagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccagggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaa

SEQ ID NO: 23713 - DNA, 743 bp, Homo sapiens
  ENST00000446493
gggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23714 - DNA, 864 bp, Homo sapiens
  ENST00000455948
gccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23715 - DNA, 3672 bp, Homo sapiens
  ENST00000481657
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacataatatctgagcatcttttttaaatatctgccataacattgtatctatttttattaagccatttcccagtcttccttgaagtttacagatatgtttgctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaagtgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtaccacttcatccctgcttcctttcgtcccgtgggactaagcattcctcgggccttcactctcaccacttgctgtccctcaaaaagccgactcacccctttccaagcgcagtgaaccgtccgcaaagcacgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataaatatcccaggattgggtgctggtgggaaaatctgctggaagcgcagcattggttaccaattttgtgctcaacctctcagtaccagggtgaaagtggagacgcaatctcccttggaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctgtctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23716 - DNA, 571 bp, Homo sapiens
  ENST00000472459
gtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23717 - DNA, 736 bp, Homo sapiens
  ENST00000428913
gcgggcgcagagctggcgctctagcccacggagttggttaactcctctcaccggcccctggaaagggttccaagtcctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23718 - DNA, 754 bp, Homo sapiens
  ENST00000451875
gcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgcaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23719 - DNA, 571 bp, Homo sapiens
  ENST00000471263
gtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23720 - DNA, 736 bp, Homo sapiens
  ENST00000437507
gcgggcgcagagctggcgctctagcccacggagttggttaactcctctcaccggcccctggaaagggttccaagtcctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23721 - DNA, 864 bp, Homo sapiens
  ENST00000443494
gccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23722 - DNA, 3672 bp, Homo sapiens
  ENST00000465992
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacataatatctgagcatcttttttaaatatctgccataacattgtatctatttttattaagccatttcccagtcttccttgaagtttacagatatgtttgctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaagtgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtaccacttcatccctgcttcctttcgtcccgtgggactaagcattcctcgggccttcactctcaccacttgctgtccctcaaaaagccgactcacccctttccaagcgcagtgaaccgtccgcaaagcacgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataaatatcccaggattgggtgctggtgggaaaatctgctggaagcgcagcattggttaccaattttgtgctcaacctctcagtaccagggtgaaagtggagacgcaatctcccttggaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctgtctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23723 - DNA, 754 bp, Homo sapiens
  ENST00000453694
gcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23724 - DNA, 743 bp, Homo sapiens
  ENST00000443142
gggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23725 - DNA, 3669 bp, Homo sapiens
  ENST00000466305
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacatatctgagcatcttttttaaatatctgccataacattgtatctatttttattaagccatttcccagtcttccttgaagtttacagatatgtttgctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaagtgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtaccacttcatccctgcttcctttcgtcccgtgggactaagcattcctcgggccttcactctcaccacttgctgtccctcaaaaagccgactcacccctttccaagcgcagtgaaccgtccgcaaagcacgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataaatatcccaggattgggtgctggtgggaaaatttgctggaagcgcagcattggttaccaattttgtgctcaacctctcagtaccagggtgaaagtggagacgcaatctcccttggaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctctctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23726 - DNA, 864 bp, Homo sapiens; identical to SEQ ID NO: 23721
  ENST00000417738

SEQ ID NO: 23727 - DNA, 736 bp, Homo sapiens; identical to SEQ ID NO: 23720
  ENST00000429558

SEQ ID NO: 23728 - DNA, 743 bp, Homo sapiens; identical to SEQ ID NO: 23724
  ENST00000441251

SEQ ID NO: 23729 - DNA, 754 bp, Homo sapiens; identical to SEQ ID NO: 23723
  ENST00000431416

SEQ ID NO: 23730 - DNA, 571 bp, Homo sapiens; identical to SEQ ID NO: 23719
  ENST00000477956

SEQ ID NO: 23731 - DNA, 3672 bp, Homo sapiens
  ENST00000466296
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacataatatctgagcatcttttttaaatatctgccataacattgtatctatttttattaagccatttcccagtcttccttgaagtttacagatatgtttgctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaagtgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtaccacttcatccctgcttcctttcgtcccgtgggactaagcattcctcgggccttcactctcaccacttgctgtccctcaaaaagccgactcacccctttccaagcgcagtgaaccgtccgcaaagcacgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataagtatcccaggattgggtgctggtgggaaaatttgctggaagcgcagcattggttaccaattttgtgctcaacctctcagtaccagggtgaaagtggagacgcaatctcccttggaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctctctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23732 - DNA, 864 bp, Homo sapiens; identical to SEQ ID NO: 23721
  ENST00000432904

SEQ ID NO: 23733 - DNA, 736 bp, Homo sapiens; identical to SEQ ID NO: 23720
  ENST00000420100

SEQ ID NO: 23734 - DNA, 743 bp, Homo sapiens; identical to SEQ ID NO: 23724
  ENST00000432227

SEQ ID NO: 23735 - DNA, 754 bp, Homo sapiens; identical to SEQ ID NO: 23723
  ENST00000444027

SEQ ID NO: 23736 - DNA, 571 bp, Homo sapiens; identical to SEQ ID NO: 23719
  ENST00000476397

SEQ ID NO: 23737 - DNA, 3674 bp, Homo sapiens
  ENST00000484199
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacataatatctgagcatcttttttaaatatctgccataacattgtatctatttttattaaaccatttcccagtcttccttgaagtttacagatatgtttgctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaagtgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacgataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtcccacttcatccctgcttcctttcgtcccgtgggactaagcattcctcctgccctcactctcaccacttgctgtccctcaaaaagccgactcacccctttccaagcgcagtgaaccgtccgcaaagcacgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataaatatccccggattgggtgctggtgggaaaatttgctggaagcgcagcattggttaccaattttgtgctcaatctctcagtaccagggtgaaagtggagacgcaatctcccttgaaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtgctttagtacccgacgctgtctgggaattccgggcgtttcggctccttggtcgcagaggcaggagggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctctctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23738 - DNA, 865 bp, Homo sapiens
  ENST00000400662
gccgcgggcgcagagctggcgctctagcccacggagttggttaactcctctcaccggcccctggaaagggttccaagtgctttagtacccgacgctgtctgggaattccgggcgtttcggctccttggtcgcagaggcaggagggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23739 - DNA, 736 bp, Homo sapiens
  ENST00000383613
gcgggcgcagagctggcgctctagcccacggagttggttaactcctctcaccggcccctggaaagggttccaagtgctttagtacccgacgctgtctgggaattccgggcgtttcggctccttggtcgcagagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23740 - DNA, 744 bp, Homo sapiens
  ENST00000400660
gggcgcagagctggcgctctagcccacggagttggttaactcctctcaccggcccctggaaagggttccaagtgctttagtacccgacgctgtctgggaattccgggcgtttcggctccttggtcgcagaggcaggagggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23741 - DNA, 755 bp, Homo sapiens
  ENST00000400659
gcagagctggcgctctagcccacggagttggttaactcctctcaccggcccctggaaagggttccaagtgctttagtacccgacgctgtctgggaattccgggcgtttcggctccttggtcgcagaggcaggagggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23742 - DNA, 572 bp, Homo sapiens
  ENST00000476699
gtgctttagtacccgacgctgtctgggaattccgggcgtttcggctccttggtcgcagaggcaggagggcacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggttgacaggcgctgccctcgatgtggtcatgaaggaatggcataccacaccagacaaatgcgttcagccgatgaagggcaaactgtcttctacacctgtaccaactgcaagttccaggagaaggaagactcttgacctttttcctgggcaactctgcagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23743 - DNA, 3672 bp, Homo sapiens; identical to SEQ ID NO: 23722
  ENST00000485907

SEQ ID NO: 23744 - DNA, 864 bp, Homo sapiens; identical to SEQ ID NO: 23721
  ENST00000437373

SEQ ID NO: 23745 - DNA, 736 bp, Homo sapiens; identical to SEQ ID NO: 23720
  ENST00000431032

SEQ ID NO: 23746 - DNA, 743 bp, Homo sapiens; identical to SEQ ID NO: 23724
  ENST00000433264

SEQ ID NO: 23747 - DNA, 754 bp, Homo sapiens; identical to SEQ ID NO: 23723
  ENST00000432545

SEQ ID NO: 23748 - DNA, 571 bp, Homo sapiens; identical to SEQ ID NO: 23719
  ENST00000459984

SEQ ID NO: 23749 - DNA, 3672 bp, Homo sapiens
  ENST00000481680
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacataatatctgagcatcttttttaaatatctgccataacattgtatctatttttattaagccatttcccagtcttccttgaagtttacagatatgtttgctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaagtgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtaccacttcatccctgcttcctttcgtcccgtgggactaagcattcctcgggccttcactctcaccacttgctgtccctcaaaaagccgactcacccctttccaagcgcagtgaaccgtccgcaaagcatgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataaatatcccaggattgggtgctggtgggaaaatttgctggaagcgcagcattggttaccaattttgtgctcaacctctcagtaccagggtgaaagtagagacgcaatctcccttggaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctctctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23750 - DNA, 864 bp, Homo sapiens; identical to SEQ ID NO: 23721
  ENST00000417275

SEQ ID NO: 23751 - DNA, 736 bp, Homo sapiens; identical to SEQ ID NO: 23720
  ENST00000444794

SEQ ID NO: 23752 - DNA, 743 bp, Homo sapiens; identical to SEQ ID NO: 23724
  ENST00000442585

SEQ ID NO: 23753 - DNA, 754 bp, Homo sapiens; identical to SEQ ID NO: 23723
  ENST00000412396

SEQ ID NO: 23754 - DNA, 571 bp, Homo sapiens; identical to SEQ ID NO: 23719
  ENST00000484119

SEQ ID NO: 23755 - DNA, 3672 bp, Homo sapiens
  ENST00000471008
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctgattataaagtctttccagtctactctgtcagtgatcttcccttcctctaaatacttgacatattttaattctacaactcatttgaaaattaatcgtggtttacactgtgatatctgtattcacatatcacttttaacattttgatgctgaaatttaggctcataaggaatgaaaactgtaatttatatctacaaatatgatgcctctatattgttggaaaggatctgatatcaaatatttggtctcactgacctcttaggaacattcttatttgtctacgtaagcttattttgagattgtaaacgtatgatcatcttacttttacttctctgtacatggcttctagcacaatacttaacattagagtctgtgatcccaagttctcaaaattaatgatttgctgattgctgatgatccttgacacataatatctgagcatcttttttaaatatctgccataacattgtatctatttttattaagccatttcccagtcttccttgaagtttacagatatgtttcctttatatgcatgttctgggctctcacattttgtacctactagcacagttttattatattctaattattcattcatgttccttgaggtcagagaacacagatttcaactttgcaggctcagcctcagctcaaaacctggcatagttgctcaataaatctttactgattagactgtgagcttttgttgggaaaaggatatgccttttaatgctttgttcctttactgcaattcacaggggatgttggctgtttttcaaattaaaaacagaaaactgaggagggtagaatttcaagttccattttcaaaggagacacacagataagtgagaataaaaactgtctacgacaatcagctcaacaacacgtctccctttgtaagacagaataacaagcaatttcacagttaaatgatagggcttgtcactcttcagcagtttgctgagttttaaccctttcactatggcgttctctccattattacagagaaaggcagatgggagcctctcccagcgaaaagactacagcttgtgtccttcataggagaaaacagtgatggctccagaacttttatatgaatgaacttagcacagctatcagagtggatggtggtgggagggctagcaggaaactagtaaacaactacaagctgccccttcagggaaagtttctacttggaatataagttacagattaatgaaaatagaaagatttcccaaagatacttattctcatgttttataaaagatcagggaaatgtcagctgtccacttaacggatgacataatgaattaagagttcgataggcggcaggcacaactaaaagccaaactcgacctaagtcttatgaaatcctacttaatgagctttcttgactactgctagcctcacttatctggcaggagtcgaaggagaggaagccccaagctcctctgttccaccacctccaaagtcctgaaccccttctcaagtgtaccacttcatccctgcttcctttcgtcccgtgggactaagcattcctcgggccttcactctcaccacttgctgtccctcaaaaagccgactcacccctttccaagcgcagtgaaccgtccgcaaagcacgaggccggttgcgagctgcagaaagcccacgctcgccagcgggacccaaggaacgctagaactatacgtcccagaacacttagctttgtttttaactacggtgcagccgcaaaagggaaataccggctcaggacccaggggagttgtagttctctaatccaaagaaatcattatttggcaacgtacggttttcagggggatataccccgcgactgcgttcctgtaggatgtgagacaaagagaataaatatcccaggattgggtgctggtgggaaaatttgctggaagcgcagcattggttaccaattttgtgctcaacctctcagtaccagggtgaaagtggagacgcaatctcccttggaagacgttagtctccatctctaacgctcccgagacacggttcgcaattaattatgacgtcacagccaatcgtcaacgcgaaagcctgacgctctagccggctctatctcgctgccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctctctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgaca

SEQ ID NO: 23756 - DNA, 864 bp, Homo sapiens; identical to SEQ ID NO: 23721
  ENST00000332435

SEQ ID NO: 23757 - DNA, 736 bp, Homo sapiens; identical to SEQ ID NO: 23720
  ENST00000376782

SEQ ID NO: 23758 - DNA, 743 bp, Homo sapiens; identical to SEQ ID NO: 23724
  ENST00000359374

SEQ ID NO: 23759 - DNA, 754 bp, Homo sapiens; identical to SEQ ID NO: 23723
  ENST00000376785

SEQ ID NO: 23760 - DNA, 571 bp, Homo sapiens; identical to SEQ ID NO: 23719
  ENST00000463141

SEQ ID NO: 23761 - DNA, 4620 bp, Homo sapiens
  ENST00000335325
tccacggcggcgaggagcgccggcgagcgcagcccgggaccgagcggggcggcgcggctggcggggccggcggcggctgaagcgagagcgcgacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcccagccctgaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagcaggttctaccctctctgctaagggcctagcacactttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctc

SEQ ID NO: 23762 - DNA, 2479 bp, Homo sapiens
  ENST00000320619
cggcgaggagcgccggcgagcgcagcccgggaccgagcggggcggcgcggctggcggggccggcggcggctgaagcgagagcgcgacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacggaagaatacaaagaagcctcagaggggctcagcctgagaaaacctggctctcaggaagaactttgcaagagcagccgtggaggacagagtgctcttgggcccccatggcccaaatgcagagttacccccactgccctgtggagaaccgggaagatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaa

SEQ ID NO: 23763 - DNA, 1069 bp, Homo sapiens
  ENST00000566250
ccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaaggtaggaggggttggcaaggtagcttagtgcaccccacctcccagaggggcggacccccatctccagccattctgtctcctttggttatgggatgacctctcccccgacctctggct

SEQ ID NO: 23764 - DNA, 1234 bp, Homo sapiens
  ENST00000567962
ccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaa

SEQ ID NO: 23765 - DNA, 607 bp, Homo sapiens
  ENST00000564320
atacctaccgtctggaaactaggctttctgcgaggctgcggagcctggcgatttagggactcacggcgtgtgttcacttgtggaagggcagagcgaagcctacctattggagttccatttattggcatcaccctcctcagagaagagagacggggtttcaccgtgttagccaggatggtcttgatctcctgacctcatgatcagcccacctcggcctcccaaagtgctgggattacaggtgtgagccaccacgcccggaatgaagtatttcaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccc

SEQ ID NO: 23766 - DNA, 485 bp, Homo sapiens
  ENST00000568511
cttccaggacatctgtttcctctgttacacattgctgcaagaagcaaaacttgtttctgctttggagcctttgagatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaag

SEQ ID NO: 23767 - DNA, 571 bp, Homo sapiens
  ENST00000579084
aaaagactctggatgcagatgatgtgctgactaaagacgcgggtgagtgtgtgatctgcctggaggagctgctgcagggggacacgatagccaggctgccctgcctgtgcatctatcacaaaaggtaggaggggttggcaaggtagcttagtgcaccccacctcccagaggggcggacccccatctccagccattctgtctcctttggttatgggatgacctctcccccgacctctggctccgagcgggtaagggcagaggccatcagacaggtgtccactgtgccggcgggaaggtgcgagcatcccaagtgcagagcagagtggagttgccagaggtgtgctctggtttgagggctcaggtggtgggagctgatggggagacccgtagagcctcacaggttggaggagcttcggatcccactgggaaggttggttctccgtctgtctccctgcctcttcttcctctacgggtccctctgctccacaggggtagaacatcaatctgtgcgaggaaggccaggcggagggtgtacccactgccttgcactggccttctccctagagggccg

SEQ ID NO: 23768 - DNA, 3980 bp, Homo sapiens
  ENST00000566244
caatactgatctcctttccctctctatggatgtatctattctggacatttcatataaatgggttcatacaataggtggtttcttttactttgtgtagtatttttgacgtttatccatgttttagcatgtggtggttcttccttttcttggcttagtaatattccattgtgtggatacatcatcttttgtttatccgttgcgcagtttgtagacactgggttgtttccacctttgggctgttgtgaacaatgctgctgtgaacctccgtgcacaaggattttcttggggacctgtttcttcctctcattcttgcctcctaccactctacccattaccatatttttccaaaccagacatcagcacactggctacgtgtgtgtttaggaaagcatctgtggagggaaacagcttgcctcatgctgcccctgcttcctgtctacccttctccaagcctttttcgtccgctgtcacctaggcttttggttaatcacatgttgagattaatcccattttgtctttgggtaattaacatgtgatgtccacgcattatctccacggtgaaagtcttaaggtcaacgtccctcttggggttctgtgtcccctgcagagccgggcacagcttggggcagctaagcagtcccctagttcctaggcccttgcttgccccatgccacctgtccactggtgactaaccctcctgcactctcccctgtcccccttgcagatgatgtgctgactaaagacgcgggtgagtgtgtgatctgcctggaggagctgctgcagggggacacgatagccaggctgccctgcctgtgcatctatcacaaaaggtaggaggggttggcaaggtagcttagtgcaccccacctcccagaggggcggacccccatctccagccattctgtctcctttggttatgggatgacctctcccccgacctctggctccgagcgggtaagggcagaggccatcagacaggtgtccactgtgccggcgggaaggtgcgagcatcccaagtgcagagcagagtggagttgccagaggtgtgctctggtttgagggctcaggtggtgggagctgatggggagacccgtagagcctcacaggttggaggagcttcggatcccactgggaaggttggttctccgtctgtctccctgcctcttcttcctctacgggtccctctgctccacaggggtagaacatcaatctgtgcgaggaaggccaggcggagggtgtacccactgccttgcactggccttctccctagagggccgggaggcaggaagagccatttcctgtggggccacagcactgggcacagttaaaagtagcagggcccagatatgccttgggactccagtgtgagcctcgtccttgtttccagctggaaggaaggcaccctcttgcccaagacaggacactgtgctgcctggggccagcacctgttgaatcctcgagcccagagcttcttcctgacactcaggcctttcaaagcctgactctcagggccactgctgcacagggtgacaaccgggcatggcacgcagtgtggctggtgcagaggaggcttaaggctggcctgggagagattcttggtctagctcccagcacggagccttgcttgtgtcccagggcggcactaaccagaaccagaaaaggaaatctttggccctcggggagaattatgccaattatctgtctggttcctgtctttgaaaatgcccagatgttggtttacaaatcaggaagctgtcttggggcaatctctgttccctctttgatgcagagagcctttctctgtaaacactggagagcagggcttcactgtctggctcccctcccgcctcttgcaggaaggactagatgctgctgatcagctgatcatggctgagccgggtagagcttggggctctcctaagaggtcacccactgggagggagcttcacagctgttcttttgacccaggaaggagctctttcaggactgtggcacccagagccgtggccctcctgccatgccattgttcccacttccctgcccttgggagtcttggagacagctgactagctgccctgaggggtccaccgctctcaccttctcactggtggctgctgccattctcctgggctctgcacagaaagctttggtccttctgaaagccactctgccccttcctgcagcaccagatccccctgagccggtactgctgcctccacctgggccaagactagtcttggtgttcacccttcttcgtgcttcagaaagtagggatatctggggacatgactgtgtttccctggggtcctttcagaagagacttaggaagctcctgctcaggaatctggccctctgaaagagccccttcaaagcagcctgggcagcaggtaacgtggtttcccttgcggccccctcctcccagctgcatagactcgtggtttgaagtgaacagatcttgtccggaacaccctgcggactgacctgcgggcttgcttgctgactcctctcaaaggtgagcccgcgtttgggggtgctccgggctcaaggcttggggtcaggtcactttgggggcctgcagtttagggagccgggctgcccttatgccactgagaagaaagcaggagcagagggaaggagcacctcatcagtgagcagttagtcatccggaaatgattttccctgggaaggacaagagatacaaaccaacatggacagttatgaagaacaggctcagaagagttaggatcagttggggaagagaccagtacaatctacattcctaaagaaagttcaggaatatcccctgggaatgtgcacgggcaggaaaaggagcctgagcggtgggtttgtgcctggcttggcctcatcctcgctcacctctgagtctccgcctcttctatggtaacggggataatctcactccctgttgccataaggacattgcacttactaaacagccatgggcagtgcattgttccctgcaaagtgctggtcagcgatcatttgaccactgcttcttcccatgccgcttccagatgaatctgaggcctccaggccagactcgatccctctatcccacagcactgggtgctgactccacacatccccctggcttaccgctgggtctggcctccccatttctcccccaggggtaccccacttgctgccaaccatccacccctgacccccatctcacctgtcccctccaagttctgggctggcattttcctttttctggcaaacaagtagacaaaacccccataaaaaccaaaagcccaactccatctcacagccaaaggttttgggacctttttcttcccccctccctttctctctctcttgctttcgttttcttttgttaggtttattttatttattccaagtaaactcccagaacagctgatgatgtcagacaaatcagggacatttgctctttttacctccacctcaaaaactgatgacaaggggagaagaaagagccaggggggagagtgaggcaggggagtagaacctgcccaggcacatggctgcaaattccccgtgtgctgtttggcttctggggtcctgtgtagacgccccagccccgcctgccctcttgggatgcagctgccctgggatgagcagacagccctcggcccgatggagcacgacttatttattacggtccacacagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcg

SEQ ID NO: 23769 - DNA, 964 bp, Homo sapiens
  ENST00000568351
atgatgtgctgactaaagacgcgggtgagtgtgtgatctgcctggaggagctgctgcagggggacacgatagccaggctgccctgcctgtgcatctatcacaaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtattta

SEQ ID NO: 23770 - DNA, 2046 bp, Homo sapiens
  ENST00000568494
aaagacgcgggtgagtgtgtgatctgcctggaggagctgctgcagggggacacgatagccaggctgccctgcctgtgcatctatcacaaaaggtaggaggggttggcaaggtagcttagtgcaccccacctcccagaggggcggacccccatctccagccattctgtctcctttggttatgggatgacctctcccccgacctctggctccgagcgggtaagggcagaggccatcagacaggtgtccactgtgccggcgggaaggtgcgagcatcccaagtgcagagcagagtggagttgccagaggtgtgctctggtttgagggctcaggtggtgggagctgatggggagacccgtagagcctcacaggttggaggagcttcggatcccactgggaaggttggttctccgtctgtctccctgcctcttcttcctctacgggtccctctgctccacaggggtagaacatcaatctgtgcgaggaaggccaggcggagggtgtacccactgccttgcactggccttctccctagagggccgggaggcaggaagagccatttcctgtggggccacagcactgggcacagttaaaagtagcagggcccagatatgccttgggactccagtgtgagcctcgtccttgtttccagctggaaggaaggcaccctcttgcccaagacaggacactgtgctgcctggggccagcacctgttgaatcctcgagcccagagcttcttcctgacactcaggcctttcaaagcctgactctcagggccactgctgcacagggtgacaaccgggcatggcacgcagtgtggctggtgcagaggaggcttaaggctggcctgggagagattcttggtctagctcccagcacggagccttgcttgtgtcccagggcggcactaaccagaaccagaaaaggaaatctttggccctcggggagaattatgccaattatctgtctggttcctgtctttgaaaatgcccagatgttggtttacaaatcaggaagctgtcttggggcaatctctgttccctctttgatgcagagagcctttctctgtaaacactggagagcagggcttcactgtctggctcccctcccgcctcttgcaggaaggactagatgctgctgatcagctgatcatggctgagccgggtagagcttggggctctcctaagaggtcacccactgggagggagcttcacagctgttcttttgacccaggaaggagctctttcaggactgtggcacccagagccgtggccctcctgccatgccattgttcccacttccctgcccttgggagtcttggagacagctgactagctgccctgaggggtccaccgctctcaccttctcactggtggctgctgccattctcctgggctctgcacagaaagctttggtccttctgaaagccactctgccccttcctgcagcaccagatccccctgagccggtactgctgcctccacctgggccaagactagtcttggtgttcacccttcttcgtgcttcagaaagtagggatatctggggacatgactgtgtttccctggggtcctttcagaagagacttaggaagctcctgctcaggaatctggccctctgaaagagccccttcaaagcagcctgggcagcaggtaacgtggtttcccttgcggccccctcctcccagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttac

SEQ ID NO: 23771 - DNA, 5331 bp, Homo sapiens
  ENST00000568844
gttaaaagtagcagggcccagatatgccttgggactccagtgtgagcctcgtccttgtttccagctggaaggaaggcaccctcttgcccaagacaggacactgtgctgcctggggccagcacctgttgaatcctcgagcccagagcttcttcctgacactcaggcctttcaaagcctgactctcagggccactgctgcacagggtgacaaccgggcatggcacgcagtgtggctggtgcagaggaggcttaaggctggcctgggagagattcttggtctagctcccagcacggagccttgcttgtgtcccagggcggcactaaccagaaccagaaaaggaaatctttggccctcggggagaattatgccaattatctgtctggttcctgtctttgaaaatgcccagatgttggtttacaaatcaggaagctgtcttggggcaatctctgttccctctttgatgcagagagcctttctctgtaaacactggagagcagggcttcactgtctggctcccctcccgcctcttgcaggaaggactagatgctgctgatcagctgatcatggctgagccgggtagagcttggggctctcctaagaggtcacccactgggagggagcttcacagctgttcttttgacccaggaaggagctctttcaggactgtggcacccagagccgtggccctcctgccatgccattgttcccacttccctgcccttgggagtcttggagacagctgactagctgccctgaggggtccaccgctctcaccttctcactggtggctgctgccattctcctgggctctgcacagaaagctttggtccttctgaaagccactctgccccttcctgcagcaccagatccccctgagccggtactgctgcctccacctgggccaagactagtcttggtgttcacccttcttcgtgcttcagaaagtagggatatctggggacatgactgtgtttccctggggtcctttcagaagagacttaggaagctcctgctcaggaatctggccctctgaaagagccccttcaaagcagcctgggcagcaggtaacgtggtttcccttgcggccccctcctcccagctgcatagactcgtggtttgaagtgaacagatcttgtccggaacaccctgcggactgacctgcgggcttgcttgctgactcctctcaaaggtgagcccgcgtttgggggtgctccgggctcaaggcttggggtcaggtcactttgggggcctgcagtttagggagccgggctgcccttatgccactgagaagaaagcaggagcagagggaaggagcacctcatcagtgagcagttagtcatccggaaatgattttccctgggaaggacaagagatacaaaccaacatggacagttatgaagaacaggctcagaagagttaggatcagttggggaagagaccagtacaatctacattcctaaagaaagttcaggaatatcccctgggaatgtgcacgggcaggaaaaggagcctgagcggtgggtttgtgcctggcttggcctcatcctcgctcacctctgagtctccgcctcttctatggtaacggggataatctcactccctgttgccataaggacattgcacttactaaacagccatgggcagtgcattgttccctgcaaagtgctggtcagcgatcatttgaccactgcttcttcccatgccgcttccagatgaatctgaggcctccaggccagactcgatccctctatcccacagcactgggtgctgactccacacatccccctggcttaccgctgggtctggcctccccatttctcccccaggggtaccccacttgctgccaaccatccacccctgacccccatctcacctgtcccctccaagttctgggctggcattttcctttttctggcaaacaagtagacaaaacccccataaaaaccaaaagcccaactccatctcacagccaaaggttttgggacctttttcttcccccctccctttctctctctcttgctttcgttttcttttgttaggtttattttatttattccaagtaaactcccagaacagctgatgatgtcagacaaatcagggacatttgctctttttacctccacctcaaaaactgatgacaaggggagaagaaagagccaggggggagagtgaggcaggggagtagaacctgcccaggcacatggctgcaaattccccgtgtgctgtttggcttctggggtcctgtgtagacgccccagccccgcctgccctcttgggatgcagctgccctgggatgagcagacagccctcggcccgatggagcacgacttatttattacggtccacacagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcccagccctgaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagcaggttctaccctctctgctaagggcctagcacactttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtca

SEQ ID NO: 23772 - DNA, 2241 bp, Homo sapiens
  ENST00000574091
atggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaataa

SEQ ID NO: 23773 - DNA, 2749 bp, Homo sapiens
  ENST00000574002
gtgtgatgttcccctccctgtgtccatgtgttctcattgttcagctcccacttataagtgagaacagaatgttaagaatcatttttgtaataactttagtttttcctacctcctgataggagacactgttttacggagcagctatttcttcctgtgttcaaagtcagttgctgaacagatggtagcttcctgcttttccggagcagaatcctagacatggatgctcctgggcccagagccatttgttcggtggctgtccccagcacaccacaggtctgggttagggcagctggcagaatacccggcgcaagctgtcaggaatcagaggccacttccttccccaatccttccgtttcagctgggagaatgggacaagattcaggtgcccccaatggggagagggtgtggatgcggctggcttcctgctataaaaacacagagcagcctaccctctacctggttgatctggtagtgtcttctgctatggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaattatctgaaaaatgcctactccatcagttctacttagcttcactcaagctgacctttctccttcggccagagacagtatccatggtgatctatcctgagtgtctctgtgagtcacccgtttctatagttacaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataagttcgaagatgataaagtcgtctatgaaaacgaaatacatgctctctggacggattttcctccaagcaaaatatctagagacagtgagttcagaatgacagtgaagtgttcttatagcaggaatgacatgctactaaacatcaacgttgaaagccttactcctccagtggcctcagtgaagttgggtccatttaccttgatcctgcaaagctacccagataattcctaccaacaaccttatggggaaaacgagtaccctctagtgagattcctccgccaaccaatttacatggaagtgagagtcctaaacagggatgaccccaacatcaagctggtcttagatgactgctgggcgacgtccaccatggatccagactctttcccccagtggaacgttgtcgtggatggctgtgcatatgacctggacaactaccagaccaccttccatccagtcggctcctctgtgacccatcctgatcactatcagaggtttgacatgaaggcttttgcctttgtatcagaagcccacgtgctctctagcctggtctacttccactgcagtgccttaatctgtaatcgactctcccctgactccccactgtgttctgtgacctgccctgtgtcctctaggcacaggcgagccacaggggccactgaagcagagaaaatgacagtcagcctcccaggacccattctcctgttgtcagatgactcctcattcagaggtgtcggctcatctgatctaaaagcaagtgggagcagtggggagaagagtaggagtgaaacaggggaggaggttggctcacgaggtgctatggacaccaaagggcacaagactgctggagatgttggttccaaagctgtggctgctgtggctgcctttgcaggtgtggtggcaactctaggcttcatctactacctgtacgagaaaaggactgtgtcaaatcactaaatgggcttctaaataaagcagtcaaaat

SEQ ID NO: 23774 - DNA, 411 bp, Homo sapiens
  ENST00000573114
acaggggagctgtgcacccaggatgggtttatggacgtcgaggtctacagctaccaaacacaaccagctcttgacctgggtactctgagggtgggaaactcatcctgccagcctgtctttgaggctcagtctcaggggctggtacggttccacatacccctgaatggatgtggaacgagatataaggttagtactggcagatggcacgaggttaagtctcatctttgacataactggctgctaacccactttctctgacatttaagttcgaagatgataaagtcgtctatgaaaacgaaatacatgctctctggacggattttcctccaagcaaaatatctagagacagtgagttcagaatgacagtgaagtgttcttatagcaggaatgacatgctactaaacatcaacg

SEQ ID NO: 23775 - DNA, 1238 bp, Homo sapiens
  ENST00000576162
ctggttgatctggtagtgtcttctgctatggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtggatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgggatggagcattgaggttggtgatggtgcaagagccaaaactctgaccctgccagaggccatgaaggaaggcttcagcctcttgattgacaaccacaggatgaccttccatgtgccattcaatgccactggagtgactcactatgtgcaaggtaacagtcatctctacatggtgtctctgaagcttacatttatatctcctggacagaaggtgatcttctcttcacaagctatttgtgcaccagatcctgtgacctgcaatgccacacacatgactctcaccataccagagtttcctgggaagcttaagtctgtgagctttgaaaaccagaacattgatgtgagccagctgcatgacaatggaattgatctagaagcaacaaatggcatgaaattgcatttcagcaaaactctgctcaaaacgaaagtatgttcaattgtcaaccactgaactccaccgggtcctgacttgaagtatactcttgtgggtagtcctcatacggctgataacttgcccgtgagctctaattgccaacataacagattcaaactccaaaaggcctcatttgatcatcttgtataagtgaaatatcaagtaactaaagttcattctctaacacaaaacctctttaacttctgtcatgaaaaatcgtctaagtctttcta

SEQ ID NO: 23776 - DNA, 942 bp, Homo sapiens
  ENST00000572752
gtgtcttctgctatggcgtgcaggcagagaggaggctcttggagtccctcaggctggttcaatgcaggctggagcacctacaggtcgatttctctcttcttcgcccttgtgacttcagggaactccatagatgtttctcagttggtaaatcctgcctttccaggcactgtcacttgcgatgaaagggaaataacagtggagttcccaagcagtcctggcaccaagaaatggcatgcatctgtggtgggtaggtaacgtgtgttatctcctcatagtcctgattagcagacagcctttggcttaggtcaatcctgtttggggagcagagtacccaaactcctgcagcaacggcatccaactcccatgatgccatggggatacctgatttgcatgaagccacccagcatggaagacctgtctgtcttcgaaagtgtgtcttatgccagcatctctgggaagcctctggctgcaagtcataccatctcaaagctcaagttctatcactgagttggggcggaagtgaagggactgaagtaccttagaaatggactggtggtcttgactctatagctttggactgtcactgaaatgtactcagccatcctgtctaacctgctctggccttggcagatcctcttggtctcgacatgccgaactgcacttacatcctggacccagaaaagctcaccctgagggctacctatgataactgtaccaggagagtgcatggtggacaccagatgaccatcagagtcatgaacaacagtgctgccttaagacacggagctgtcatgtatcagttcttctgtccagctatgcaagtagaagagacccaggggctttcagcatctacaatctgccagaaggatttcatgtctttttccttgccacgggtcttctctggcttggctgacgacagtaaggggaccaaagttcagatgg

SEQ ID NO: 23777 - DNA, 2241 bp, Homo sapiens; identical to SEQ ID NO: 23772
  ENST00000640487

SEQ ID NO: 23778 - DNA, 2749 bp, Homo sapiens; identical to SEQ ID NO: 23773
  ENST00000638300

SEQ ID NO: 23779 - DNA, 411 bp, Homo sapiens; identical to SEQ ID NO: 23774
  ENST00000639836

SEQ ID NO: 23780 - DNA, 1238 bp, Homo sapiens; identical to SEQ ID NO: 23775
  ENST00000640213

SEQ ID NO: 23781 - DNA, 942 bp, Homo sapiens; identical to SEQ ID NO: 23776
  ENST00000640539

SEQ ID NO: 23782 - DNA, 5595 bp, Homo sapiens
  ENST00000396976
agtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtcttccaatagtgagattcatctactattctgtgtccagttagcttaggaaattcactttaggatttatgccactgtttgttccttgtttttcctgatctagactcaaatccccaaggcagtctaaagaatgaaaggaagatttcagtccctctctttgcctgcatctgaattgatggataacatcttttccctctcagtgcctatggtgttcccttaatataagcacagaggacaaggtaatagatcctatgaatttgataagcatccttctttactcattctgtcattcagctgcattttgacaggaaaaacccattacatttcgagaagaagttatgagactttgcccattaggtgggtctagctcttttttttttttttggagacggagttttgctcttgttgcccaggctggagtgcaatggcacgatctcagctcactgcaacctctgcttcccgggttcaagtgattctcctgcctcagcctcccaagtggctggaattacaagcatgcgccaccatgcccagctaattttatatttttagtagagatggggtttctccatgttgggcaggctggtctcaaactcccgacctcaggtgatctgcctgcctcggcctcccaaagtgctgggattacaggcatgagccactgcgccgggcttttttttttcgagatggagtctcactctgtcgtccaggctggagtgcagtggcatgatctcagctcactgcaacctctgccttctgggttcaaacaattttcctgcctcagcctcctgagtagctgggattacagccacctgccaccataccaggctaaattttgcatttttagtagagatggggtttcaccatgttggccaggctggttttgaattgacctcatgatctgcctgcctaggtctcccaaagtgctgggattacaggtgtgagccactgcacccggcccagctcttctttatacaataatggaaatgctaaaatgaatgactcttcctgctcacttaaacctgtgctcaaaatgacatatttgtcaggcaccctcttcatttaccttaaagaaggagagtttaatgtccatcttggttctgccctatgaatcatcttgtcaagaacaggtgttcttatgcagaaacaatgaaaaccttatactgaagtgtgaaccctggatttcttagtttcttctgagtcctagaagaagggttggaatagaataatacatttacaggatttaggttggttttctttctgtccagtctcatctgaatttcgtctgtctcttgtggtccagaagttccacagagcaacgcagctgcatgtggtgacaggtagagcagttaaagctgccaataggaactcgtccatattccacacacctggtatagtgttatgccctccatgggcacttacctgcaataagcagaagccactgccacattcccgtgtattgggaaaatggactactgtgtgcgaacaggccctttaccctaatggcagggaagatggattatctttggccagtggagctgccaatctagacatacacattcaactgaatacaattaaaagcagttctttaaatgcaaatataattactcatctttataatacaatagtattaactgcccatatgctcatagtatgatgagccctgtatagcacaaggtcaacaggtcctctccttgtccttacaatctaaagcagatgacactgacatggacaaacaagtgcacatgcatagttgcggcagttttagagaaatctagaaagctaggtagcaacactatgcataaatgttgtggtccaatgcattagtttgctttaacaaaaatctgggaggtattttttctctttattcaggaaggcttcatgaagcaggaagtggtcaaaggagggaaggttactggttaaattatgataggaagaactttccataactagttgcaaaattgagtgctgggtgggttgaggaatgggaaaaagggggagcaaggtgttttgtgtagatggaacaaagggcaaaggatagactgtaaggaaggccagataaagcttggagtagcatgagaacttgaggaatagtatgatatgggctgtgcagcaggcagagagaatcaccttagctgaaacatgggtgttaggagcagaccatgaggtggtagaaccatcatctatagtaaatcaggtactacgctataactattgataaggaaacagctgactgccactgaaagaataagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaaacaccagtctgaagcagtgcctcaggatctcagatgatttaggaagtgtgctgtaatgtcaaaaaaaaaaaaaagtattgtctttagtatatctatgtatagtctcgtgggaaaagcattggttgtggtatcaacagatattctggttccagatgtcttgtaagttaacctgcctccatttccctttctgtaaagcaaaataatgtttacacctaatctgtctctcagggataccatattaataaaaatcatgtctataaagtg

SEQ ID NO: 23783 - DNA, 2834 bp, Homo sapiens
  ENST00000566849
gtattccttctgatagtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggagcctgagcttaggtgaattctcatgatgcagatgataggactgaggaattcaggctctaaagctctggattaagtggtgctgaaatttctcttctggtggcaggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtc

SEQ ID NO: 23784 - DNA, 2345 bp, Homo sapiens
  ENST00000562072
atggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaa

SEQ ID NO: 23785 - DNA, 1389 bp, Homo sapiens
  ENST00000568898
atggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaa

SEQ ID NO: 23786 - DNA, 1724 bp, Homo sapiens
  ENST00000570181
gaacaatgtccagaaaatggagaggaggcagtgactctcgtggaagatttagaaagagagcctggaagacctagatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggattgccatttcctaaatccggtgtggtctccaggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggagcctgagcttaggtgaattctcatgatgcagatgataggactgaggaattcaggctctaaagctctggattaagtggtgctgaaatttctcttctggtggcaggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggtaagattatttcactattatggtataaataacaaagggaagacaatgggacttaggaaaaatatcatctgattgagaactggcctctacacccagctttcatggattcttcttgtgaccacccatatttcttgtctattaaagcagctcactgaggggatataaa

SEQ ID NO: 23787 - DNA, 643 bp, Homo sapiens
  ENST00000561661
gtacttgggaggctggagagccggggccggggccggggccggggccggggtcagggtcggaccccgagtgggtgaggctggcccggaggcaaggatgcgagggggttgaggggcagctcgagagggagacgctcccaggggtgggctggagggcgccctcagggcgccttagccgggtcagaggcctctggagggaccgcacgacggctccgggttacccggccggagggagcggagacaaaagaggccagaatcccgcagccgctgctccttgggctgagagctctgcgtccgcgaaccggcagcacctggagcctctggccgacacccgagcccgtcctcaggaagcccgttactactgctcctcggattccgtctctcctgcccaatgtgactctccccaagcccccatggtcctcgctttggagccaaaaccagcttctctccttgcgcgaggttttccgacaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttc

SEQ ID NO: 23788 - DNA, 701 bp, Homo sapiens
  ENST00000563508
cgagagggagacgctcccaggggtgggctggagggcgccctcagggcgccttagccgggtcagaggcctctggagggaccgcacgacggctccgggttacccggccggagggagcggagacaaaagaggccagaatcccgcagccgctgctccttgggctgagagctctgcgtccgcgaaccggcagcacctggagcctctggccgacacccgagcccgtcctcaggaagcccgttactactgctcctcggattccgtctctcctgcccaatgtgactctccccaagcccccatggtcctcgctttggagccaaaaccagcttctctccttgcgcgaggttttccgacagcaggatggtgacttgtctttagatcctctcgaactccagctctcctatatggttcggactcactgtgcaacattggccagggaagttaaatgggatcggatttggaggaggtgggagaggggcagacagtacttttattctctgctgcttcctggggctgccctggaagtcaaccagaaaagcagtttttgcaaagtctatttactgaagattgtgctaccttagaaggccactcggagcacatggaaaggcaggccagctctggcaagactttagacatatgaatgtattccttctgatagtgccatctttctctgccctaggaagaaacacctcttacagtcatctgca

SEQ ID NO: 23789 - DNA, 2831 bp, Homo sapiens
  ENST00000396972
gtattccttctgatagtgccatctttctctgccctaggaagaaacacctcttacagtcatctgcaggggattctccaaggacatgggaagatagatgtaagccctggaacccagactcctaagcgaagggaagctgcattctgctattaatgatggccaaatcagctctaagagagaatggcactaactctgagaccttccgacagcgtttcaggagattccattaccaggaggtggctgggccgcgggaggctttcagccaactctgggaactttgctgtcggtggctaaggccggaggtgcgcaccaaggagcagattgtagaactgttggtgctagagcagttcctgaccgtcttacctggggagatccagaattgggtacaggaacaatgtccagaaaatggagaggaggcagtgactctcgtggaagatttagaaagagagcctggaagaccatcttcggtcacagtctctgtgaaggggcaggaagtgcgcttggagaagatgacacccccgaaatcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggttggagcaaggagagccatggatcccagatctgctgggctctaaggagaaagaacttccaagtggcagccacataggagacagacgagtgcatgctgatctgttaccatccaagaaagatagaagaagctgggtggaacaggatcactggagctttgaagatgagaaggtggcaggtgtgcactggggctatgaagagaccagaacgctcctcgcaattctcagccagactgagttttatgaggctctcagaaactgccataggaacagccaagtgtatggggctgtggctgagcggctcagggaatatggcttcctccggaccctggaacagtgtcggaccaagttcaaaggtctccagaagagctatcggaaagtcaagagcggccacccacctgagacctgccccttctttgaagagatggaagccctgatgagtgctcaggtcattgccctgcccagtaatggcctggaagcagcagcctctcactctggcctggtaggcagcgatgctgagactgaagagccagggcagaggggctggcagcatgaggagggagcagaagaggctgtggctcaggagtctgacagtgatgacatggatctagaggcgaccccccaggaccccaactcagctgcacctgttgtgttcagaagcccaggtggagcctgagcttaggtgaattctcatgatgcagatgataggactgaggaattcaggctctaaagctctggattaagtggtgctgaaatttctcttctggtggcaggtgtacactggggctatgaagagaccaagacttaccttgcaattcttagtgagacccagttttatgaagccctccggaactgtcaccgcaacagccagctgtatggagcagtggctgagaggttatgggaatatggctttcttaggaccccagaacagtgtcggaccaagtttaaaagcctgcaaaccagctatcggaaagttaagaatggccaggcaccagagacctgtcccttctttgaagagatggatgctttggtgagtgtccgggttgctgccccacccaatgatggccaggaagagactgcttcttgccccgtccaggggaccagtgaggctgaagctcagaagcaagctgaggaagcagacgaggccacagaggaagattctgatgatgatgaagaggatactgagatacccccaggggctgtcataacccgtgctccagtgttattccaaagcccccgtggttttgaagctggatttgagaatgaagataattcaaaacgggatatttctgaggaagtacaactgcataggacattacttgcaagatctgaaaggaaaattccccggtatcttcatcagggtaaaggcaatgagagtgactgtagatcaggaagacagtgggcaaagacctcaggggagaaaagaggaaaactgacactcccggagaagagcttaagtgaagtcctaagtcaacagagaccttgcttgggagagagaccctataaatatctcaaatacagcaaaagctttggtccaaactcccttctcatgcatcaggtatcccaccaggtggaaaatccatataaatgtgctgattgtgggaaaagcttcagtcggagtgcacgactcattagacaccggagaatccacactggagagaaaccttataaatgtcttgactgtggaaaaagtttccgtgacagttcaaatttcatcacccataggagaatccacacaggagagaaaccttatcaatgtggtgagtgtgggaaatgcttcaatcagagctcaagccttatcattcaccagagaacccacacaggagaaaagccctatcaatgtgaagagtgtggaaaaagcttcaataacagttctcattttagtgcacatcggaggatacacacaggagagagaccccatgtgtgtcctgactgtggaaagagtttcagtaagagttctgacttacgtgcacatcatagaacccacacaggagagaaaccctatgggtgtcatgactgtggtaagtgcttcagtaaaagctctgcccttaataagcacggagaaatccatgcacgggaaaagcttctgacacagtcagctcccaagtaagcccctgaggatatataacggaaagaggctcaataaatgtattgtttagaaagtc

SEQ ID NO: 23790 - DNA, 4097 bp, Homo sapiens
  ENST00000333206
tgtccctagcagtgccttagccagggacctgcttggccagcgacagatcctttgctgctctgtctgccggttcttgaggtgaatgtcggaatccattatctttcgggaaagctctctggggcagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagtttt

SEQ ID NO: 23791 - DNA, 4323 bp, Homo sapiens
  ENST00000420878
attaacccccgaaccgccgcgagctgtccctagcagtgccttagccagggacctgcttggccagcgacagatcctttgctgctctgtctgccggttcttgaggtgaatgtcggaatccattatctttcgggaaagctctctggggcaggcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagtt

SEQ ID NO: 23792 - DNA, 2028 bp, Homo sapiens
  ENST00000590777
ttccttgttcaccatccctcttctccaatactaattcatttctttgtctaccttactctccaagggggccatatttggctaccccaggccacttctctgaattctagattgggaatctagttttgagaactgtcctcctaataaataaatacctatttcattgagtttgtgttcctgctacaacagtttcttctgtcatgggaagtaaatgatacttacactttctattcacatttttagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagg

SEQ ID NO: 23793 - DNA, 3368 bp, Homo sapiens
  ENST00000589178
gtgccttagccagggacctgcttggccagcgacagatcctttgctgctctgtctgccggttcttgaggtgaatgtcggaatccattatctttcgggaaagctctctggggcagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggggtctcactctatcacccaggttggagtgcagtggtgcaaccacagctcactgcagcagccttgaacccctgggttaaagtgatcctcctgcctcagcctccagagtagctaggactacagttgtacaccaccatgcctggctaaatatccataatattcaaagctcagtattctgttatttaattttggcttcattggcaagacagtccctaagatggagatgaatacattttcagtaatagaaaccacataatcatttgaacagggaaagtttaatgttaagaattattaactactaagtgttataacaaaaagtgaaactcaaaagaatacagcaataacagatatagagtgtctctagggctgaggcagaacatcaaaggtaagaacaaatttgcaggagggtgccacaacttcccctttcctgccaggtcttagatccaggccttgttggagagggcacagccacagcccactggatggagatgccactgcagtgctgagctggcagaactcactgaggagccacactctggggtgctagaagctccccatggggagctgacctggtacagaacttgctgggaagctacccatagggatggggcctttggaactcattgggatgtgcactgctgggtgtcccatgtgctacagaaacaaacacaaagaacatgccagaaccaggaagaaaagccctttcttccagttcctctgcaaccccctctattgataaagctcacagcatgccagctggcaaatagtccagtatcacagacagggcaatgaagcgtagatttgaaactgaggcaataaattgatagctgtcacagatgccagggattagaactgaaaggactttgattatgttattggcaaaatcatccttatgggcagcagatatatcaggtataccagcttgttctcattaatcttttgttaaatctgactacccttctgattttgtcttcaccaagcaatcttattaacttcctatgaagcttagctgtaataagaaaattgcatttgttcagtctggtccatgtgatggttacattactcattaattctcattctgtttttattactgagtttcacgggcttagttattaagagtctaccccaagagataaatctattttttgtatgatgataaaattaggtatatgaggacctaagcccaaaggccagaccctggacctcggcagttcaccaaaggaatccataccatccatccactgaattcttctgggaaactgcttcccaaccttccccaggcatcataccctgatactaccattagccaagcaggccctcttaagtatcttctgcaccaagcaggtgctacattaaaacgggttttgaaaattcatctcaaggaaatcaagctgtctctatttgcagataatatgatcccatgtctagaaaaccctatcgtctcagccccaaagcttcttaagccaagaagcaactacagcaaagtctcaggatacaaaattaatgtgcaaaaatcataagcattcctatatacagagattcctatatctctgtgtctgtactgcacacctgaacaacaataagacaaccagagagccaaacatgattaactcccattcacaattgctacaaagagaataaaatacctaggaatacagctaacaagggaggtgaagggcctcttcaaggagaactacaaaccactgctcaaggaaatcagagaggacacaaacaaatggagaaacattccatgcttatggataggaagaattaatatcatgaaaatggccatactgcccaaagtaatttatagattcagtgttattcccattaaactaccattgacattcttcacagaattagaaaaaaatactttaaaattcatatggtacaaaaaaaagagcccttatagccaagacaatcctaagcaaaaagaacaaagctggaggcatcatgccacctgccttcaatctgtactacaaggctactataacccaaacagcatggtactggtacaaaaacagacacatagaccaatggaacagaatagagatctgagaaataagactgcacatctacaaccacttgatatttgacaaacctgacacaaacaagcaatggggaaaggattacctatttgataaatggtgctgggaaaactggctagccatatgcagaaaactgaaactggatccctcctttacaccttgtacaaaaataaactcaacatggactaaagacttaaatgtaaaacccaaaactataaaatccctagtaaaaaaatctaggtaataccattcaggacataggcatgggcaaagatttcatgatgaaaatgtcaaaagcaattgcaatagaagcaaaaattgacaaatgggacgtaattaaagagcttttgcacagcaaaagaacctattataagagtgaacagacaatgtacagaatgggagaaaatttttgcaatctatccatctgacaaaggtctaatatccaggatctacaagaaacttaaacaaatttacaagaaaaaaacaaccccattaaaaagtgggcaaaggacatgaacagagacctcaaaagaagacatttatgcacc

SEQ ID NO: 23794 - DNA, 464 bp, Homo sapiens
  ENST00000588448
gagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagaggtgagaagccccagtccatgtggggttgaggatggaggtgagagctatcaactgtggcacggttcattttcttaacgacagccacttgtggctatcactaagtattgtggaaaggcttctttgcctagaaatattcttccttaggctctgcctagaatctgaaattccagtatcatttgtaactttgggttaagaattaaagtctttagtaaaattc

SEQ ID NO: 23795 - DNA, 510 bp, Homo sapiens
  ENST00000601405
tgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagagaaatgttctggcaggaaatgacatccacaggagcactgaagtctctgtctctgaatagcccggtgcagcccttagagaaccagtgcaagactgagactcaggagtcccaggctttccaggagagaggtgagaagccccagtccatgtggggttgaggatggaggtgagagctatcaactgtggcacggttcattttcttaacgacagccacttgtggctatcactaagtattgtggaaaggcttctttgcctagaaatattcttccttaggctctgcctagaatctgaaattccagtatcatttgtaactttgggttaagaattaaagtctttagtaaaattc

SEQ ID NO: 23796 - DNA, 731 bp, Homo sapiens
  ENST00000592278
aaccgccgcgagctgtccctagcagtgccttagccagggacctgcttggccagcgacagatcctttgctgctctgtctgccggttcttgaggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggagttttctgcttgtgtatcctcagaatgatagtgctggtacttgattactcctaggacacaactcatggccaagaaatgttctggcaggaaatgacatccacaggagcactgaagtctctgtctctga

SEQ ID NO: 23797 - DNA, 588 bp, Homo sapiens
  ENST00000592598
gcaggacccgtccccgccccagcccttccgcagctcctaggactgtcgtcttcgcagtcagcacgtccgcgcagcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctg

SEQ ID NO: 23798 - DNA, 549 bp, Homo sapiens
  ENST00000592211
aacccccgaaccgccgcgagctgtccctagcagtgccttagccagggacctgcttggccagcgacagatcctttgctgctctgtctgccggttcttgagcgcgtcaaccgcttgtactctgcgatgcccccgccaggtctgagccggacccgcgcccctcctgcgagacacgacccgcgcctgccacagagctgcggtcctccgggctcctagaggggcactctcccacttccggcgcgcgtgcggccgggcattgttctcgctcccgggggtgggttcccgccgccgccggtagagcgaagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccg

SEQ ID NO: 23799 - DNA, 581 bp, Homo sapiens
  ENST00000588832
attaacccccgaaccgccgcgagctgtccctagcagtgccttagccagggacctgcttggccagcgacagatcctttgctgctctgtctgccggttcttgaggtgatcctgaagctgttggtcctgggaccacattttgagaaccactgcccaagaaataagtgatgctcagtaattaatccctgaattaacggaaagttggatttttatctactttgcaatctagaaagggtacgaggtctatttaaggtttgcttgctagaacaattctcactgatcagggtgagaaggacccgaaatggagggtgcggggtaatcagggtaggaaaggatattgctgtgttcatggaaatatcttgggaaatgaggagttgggacctcatttctgttgagaccaatgagacgtgtgacttggtttaagctgtccggtggggaaaggaagaggtttgagaaaatggtgggtggctaagtggtagttgaggtggaggaagagggcttcctgtcccagcccaagtccctgttgggatatatgaaatttagggatgtatgactaagcccttaatataaccgtaagaggaaag

SEQ ID NO: 23800 - DNA, 3439 bp, Homo sapiens
  ENST00000610712
agggctgccgagaattaacccccgaaccgccgcgagctgtccctagcagtgccttagccagggacctgcttggccagcgacagatcctttgctgctctgtctgccggttcttgagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacataaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagttttaaaagttt

SEQ ID NO: 23801 - DNA, 1305 bp, Homo sapiens
  ENST00000639929
caagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggtaagaaaaataccacttgacccagcaatcccattactggccattatcctcagcaaactaacacaggaacagaaaaccaaacaccacttgtgtcccttcaaaattcatatgttgaagctatggagtctggctctgtcgcccaagctagagtgcagtgcctccaaaagtgctgggattacaggtgtgagccaccgtgcccagtctctacttgacaatatgaattttagaggtgattcaggaacctgtatttcttttctctggcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacacc

SEQ ID NO: 23802 - DNA, 5501 bp, Homo sapiens
  ENST00000252744
atggcggagcgcggacagcagcctcctcccgcgaaacggctttgctgccggccgggcggcggcggcggcggcgggggcagcagcggcggcggcggcggcgcgggtggcggctacagctctgcctgtcggccaggcccgcgggcgggtggcgcggcggcggcggcggcgtgcgggggcggcgcggcgctggggttgctgccgccgggcaagacccagagccccgagtcgctgctggacatcgcggcgcgcagggtggcggagaagtggccgttccagcgcgtggaggagcgctttgagcgcatcccggagccggtgcagcgccgcatagtctattggtccttcccccgcagcgagcgggagatctgcatgtactcgtccttcaacaccggcggcggcgccgcgggcggccccggcgacgacagcggtggcggcggcggcgcgggcggcggcggcggcggcggctcctcgtcttccccggccgcaacctcggcggccgcaacctcggccgccgccgccgctgccgccgccgccgccgccgccgccgccgccgcgggggccggggccccgtcggtgggggctgccggggcggcggacggcggcgacgagacgcggctgcctttccgccggggcatcgcgctgttggaaagcggctgcgtagacaacgtcctgcaagtcggtttccacttgagcggcacagtgacagaacctgcaatacaatcggagccagaaactgtttgcaacgtggccatcagctttgatcgttgcaagattacctcagtgacctgcagctgtggaaacaaggacatattttattgtgcccatgttgtggcactgtctttataccgcatccgcaagccagatcaggtcaaactgcatcttcctatttcagagactctctttcaaatgaatagagaccaactgcaaaagtttgtacagtatttgatcacagtgcaccacacagaagttttgccaactgctcaaaaattagcagatgaaattctttcccaaaattcagaaatcaaccaagttcatggtgctcctgatccaacagcaggtgctagtatagatgatgaaaactgctggcacttagatgaagagcaggttcaagaacaggttaaactgttcctttcccagggcgggtaccacggatcagggaagcagcttaatttgctctttgcaaaggtgcgggagatgttaaagatgagggactccaatggggcccgcatgttgaccttgataacagagcaattcatggctgaccctcgcctgtcactttggcggcaacaaggcactgcaatgactgacaaatacaggcagctctgggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagtt

SEQ ID NO: 23803 - DNA, 3942 bp, Homo sapiens
  ENST00000371532
gggaatatcctctcaagccctgaggtgcagggctgggaaggagtgggtgagcggctgggtcgtggcaggttggtctggggaggctggggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagagaaatatatttttttacctttttttttttttttttttttgtgacggaatctcgctctgtcgcccaggctggagtgcagtggcacaatctcggctcactgcaacctctgcctcccaggttccagcaattctcctgcctcagcctcctgagtagctgggactacaggcacatgccgccacgcccggctaatttttgtattttttagtagagacagggtttcaccatattggtcaggctggtctcgacctcctgacctcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatgagaaaaa

SEQ ID NO: 23804 - DNA, 4469 bp, Homo sapiens
  ENST00000371528
aaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggcaagctgactgacagaacagccagcattttccgaggcaaccaaatgaaactgaagctggtcaatatccaaaaagctaaaatctctacagctgcattcataaaagccttctgccgtcataagctcattgaactgaatgctactgcagtgcacgctgacctcccagttccagacatcataagtggactctgcagcaataggtggatccagcaaaacctccagtgtctcctgttagactcgacaagcatccctcaaaattcaagattactgttctttagtcagctcactggtcttcgcattttaagtgtttttaatgtttgttttcatactgaagacctggctaatgtttctcagttaccaagactggaaagcttagatatctctaatactctagtcactgatatttctgcactgcttacctgtaaggatcgattgaagtctctcacaatgcactatctgaaatgcctggccatgaccaaatcacaaattcttgcagtcattagagaacttaaatgtctgcttcaccttgatatttctgatcacaggcaactcaaatcagacctagcttttcatttgctacagcagaaggatatcctgcccaatgttgtgtcattggatatttctgggggcaattgcatcactgatgaagctgtagaactgtttatacgactgcggcctgccatgcaatttgtgggactattggccacggatgctggctcttctgacttctttactacaaagcaaggcttgagggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagagaaatatatttttttacctttttttttttttttttttttgtgacggaatctcgctctgtcgcccaggctggagtgcagtggcacaatctcggctcactgcaacctctgcctcccaggttccagcaattctcctgcctcagcctcctgagtagctgggactacaggcacatgccgccacgcccggctaatttttgtattttttagtagagacagggtttcaccatattggtcaggctggtctcgacctcctgacctcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatgagaaaaa

SEQ ID NO: 23805 - DNA, 3682 bp, Homo sapiens
  ENST00000612017
gggaatatcctctcaagccctgaggtgcagggctgggaaggagtgggtgagcggctgggtcgtggcaggttggtctggggaggctggggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggaagaggcatctccctacactttggtcaacatctgcctgaatgtcctgattgctaacctggagaaattgtgttctgaaagacctgatggaacactgtgccttccggagcattggagtttccctcaggaagtagccgagcgatttctcagggtgatgacttggcaaggttgctggaggagccagtatgagtcagatttcagaagcactgagccgatacaggaacagatcatgttttgtgaaggaagccctccacaggctgttcacagagacattttcaatggaggtaaccatgcctgctattttaaagcttgtggctataggaatgaggaatcacccattggatttgcgagtgcagttcacagccagtgcttgcgctctcaacctaacacgccagggcctggccaaggggatgcctgttcgcctgttgtcagaggtcacctgtctacttttcaaggctctgaaaaatttcccccattaccagcagttacagaagaattgtcttctctccttaaccaattccaggattcttgtggatgttccatttgacaggtttgatgctgccaagtttgtcatgagatggctctgtaagcatgaaaaccccaagatgcaaacaatggcagtgagtgtcacctctattctggctctgcagctctcacctgagcaaacggcacagcttgaagagcttttcatggcagttaaggaacttctagcaatagtaaaacaaaagactactgagaatttagatgatgtcaccttcttgtttactttgaaagcactttggaatcttacagatgggtctccagctgcctgcaagcacttcattgaaaatcaaggattgcaaatcttcatccaagtcttggagaccttttcagagtcagcaatacaaagcaaagtacttggtcttttgaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctgaacctaaggaatttcagaggtgtgtgctcttcctcaatgtcaggtgttctgccctggcagtaattgcacatcagttgtcattggagtttgtgagttggctgtctcattggcctttgattgttgattttatatatgttacaaaaggttggatttgtatgatagctgtaatcccaagtcaagttggactcattctgcagcctttcagcagcaattttgaagactcaaaccgtggactctgggaaggcctgggagcttgtgttggaacagctatgcaagttacttttctctagccttggacaattttttccctttgggagcttgtcatgggagtgggacctgttcactagaagagaaaggaaacctacagggagactttgatatttatattaaatttcctttgttgttatcgtcatgtgaagctatgagaaaagcttgggaagcatatgcttcaaaatgtagtgtttagaaggcagaacccctgttggagagcggggaaaagaatttatttatttatttatttatctatggctgggtatggtggctcacgcctgtaatcccagcactttgggaggccaaggcaggtggattgtctgaactcaggagttcgagatcagccttgccaacgtggtaaaactccgtctctaccaaaaaatacaaaaattagctgagcgtggtggtgtgcacctttactcctagctacttggaggctgaggtgggaggaccacttgagcccaggaggcagaggttgcagtgagctgagattgcaccactgcactccagcctggatgacagagtgagacctcatctcaaatgaatagaggggtggagaaaagactcgtgatccacccgtctcggcctcccaaagtgctgggattacaggtgtgagtcactgcacctggcctttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacattttaggattagatttttgtgcttttggctggcttggttcagattcttaactagagtaccatgtactgtctttggaaatcaaatgaggaagaagctcattctcttactctaaaccatgttccaaactattaccagagtccaaccagataagcagaatttgtaaccttacttccttccatagtccttaaactgtactgtattttttcacactcttgcatgattccaaaaggatatcttcctgacctgggttctagtacctcagagcattgttatcagatgctagcttattctaatgtgaggatgtgttaggggaactagtgtgttaagtccaattctgtacaagacatcctttcaagttctgtgtcattcacaacaatcctcacgggtaggtgagttttattttcctcacttaacagatg

SEQ ID NO: 23806 - DNA, 2493 bp, Homo sapiens
  ENST00000322764
ctgagccgggctggggcggcgggggcggcagtgagtggggtgggggcgagcggacctcggcggagcctccggcctgaggcaggatcagggccccttcctgggggagtttcctgcctggtccgcccttccccgctctccccgccccctctccgggccgctccttgtatggtctgggcgccgctctctccccgccccctctcttctccctccctcctccttccgtgtgtccctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaa

SEQ ID NO: 23807 - DNA, 533 bp, Homo sapiens
  ENST00000449630
ccttccgtgtgtccctccccgcccggctggaggctgctccggaccgggacgcagagtctgcggacccggcgccgaggcggccacccgagacgcggcgcgcacgctccggcctgcgactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctct

SEQ ID NO: 23808 - DNA, 1146 bp, Homo sapiens
  ENST00000468083
ccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtacggaggcctgggaggggcggctgcactggacacccccaaggagaggagaagagggccctttcttcttacctcccctgcacctctgccttgggggtggggggatagaggcatggaataggtgctctgacctctgaccctctagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctccc

SEQ ID NO: 23809 - DNA, 703 bp, Homo sapiens
  ENST00000457235
cggcgccgaggcggccacccgagacgcggcgcgcacgctccggcctgcggtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttc

SEQ ID NO: 23810 - DNA, 2050 bp, Homo sapiens
  ENST00000354434
gcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 23811 - DNA, 2123 bp, Homo sapiens
  ENST00000392910
agatgttcttacctcatcgtggagctcgtggctgggagccagggctcctgggaccgttccaagtcccccgcctgggagtgggagtcgggaatgtggggcacgaatcttcccctccgggtccgttttccgaagtgtaacgggagctgcaccactcctcggcagtgcgcccggcctttcctgacctgactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 23812 - DNA, 504 bp, Homo sapiens
  ENST00000477373
gttttccgaagtgtaacgggagctgcaccactcctcggcagtgcgcccggcctttcctgacctggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagctt

SEQ ID NO: 23813 - DNA, 632 bp, Homo sapiens
  ENST00000436448
agtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggggctgctcagcagcaggcaggccgggtgcgctcccctggggccccagggcccctgactctgaaggaggtggaggagctggagcagctgacccagcagctaatgcaggacatggagcatcctcagaggcagaatgtggctgtcaacgaactctgcggcc

SEQ ID NO: 23814 - DNA, 926 bp, Homo sapiens
  ENST00000446634
tccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccagttcaggaaataagatcgtccaatttctggtgacgaagatgaccctgatggtcatctagtccaagcatccagagtccactgatagtgttgatgtctacctacactcggacacagcataggaagaaatgccaagggccagtgagctttgcagaatcctgggctgctcagcagcaggcaggccgggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctcct

SEQ ID NO: 23815 - DNA, 560 bp, Homo sapiens
  ENST00000497119
ccggtgcttcagtgacccgagctgctgtgtgcgtggcctccgtccgcccagtcattctggcctgtctgtgactgctcagggggtttgggcagagtgggtggaaatgtcttgctgtacgagatccaggcttaggtcccttcccctgttatttgtgtggtgctggggatggcgggggtagggggacgagggagaagctttaagggtcaagcctgagcatctgggacacgagctgggagctaagcctcatcggaagaagccgggtaggctggcctgggaaggttcttggaggcagcagccctctagagtgtgaggaaaatgttgggattgcaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagca

SEQ ID NO: 23816 - protein, 1474 aa, Homo sapiens
  ENSP00000323929
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 23817 - protein, 73 aa, Homo sapiens
  ENSP00000438599
NGGTLLGLKKLSFYYLIMAKGGIVRTGTHGLLVKQEDMKGHFSISIPVKSDIAPVARFTTCYQKRTSLASLGL

SEQ ID NO: 23818 - protein, 90 aa, Homo sapiens
  ENSP00000445717
MGKNKLLHPSLVLLLLVLLPTDASVSGKPQYMVLVPSLLHTETTEKGCVLLSYLNETVTVSASLESVRGNRSLFTDLEAENDVLHCVAFA

SEQ ID NO: 23819 - protein, 168 aa, Homo sapiens
  ENSP00000385710
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQ

SEQ ID NO: 23820 - protein, 926 aa, Homo sapiens
  ENSP00000377040
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGYMKALNGFVKLGLINREALPAFRPEANPLTWKQLLCDLVGISPSSEHDVLKEAVLKKLGGDNTQLEAAEWLGLLGDEQVPQAESILDALSKHLVMKLSYGPEEKDMIVMRDSFGIRHPSGHLEHKTIDLVAYGDINGFSAMAKTVGLPTAMAAKMLLDGEIGAKGLMGPFSKEIYGPILERIKAEGIIYTTQSTIKP

SEQ ID NO: 23821 - protein, 926 aa, Homo sapiens; identical to SEQ ID NO: 23820
  ENSP00000403768

SEQ ID NO: 23822 - protein, 511 aa, Homo sapiens
  ENSP00000414001
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITDLT

SEQ ID NO: 23823 - protein, 732 aa, Homo sapiens
  ENSP00000351834
MLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGLEC

SEQ ID NO: 23824 - protein, 21 aa, Homo sapiens
  ENSP00000394180
WIGMLNNVEYLPMVSSLTPSP

SEQ ID NO: 23825 - protein, 1374 aa, Homo sapiens
  ENSP00000324196
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 23826 - protein, 105 aa, Homo sapiens
  ENSP00000460986
SEEASAPDAPDALPDSPTPATGGEVSAIKLASALNGSSSSPEVEAPSSEDEDTAEATSGIFTDTSSDGLQARRPDVVPAFRSLQKQWPQREESLPRLCLLLRPRG

SEQ ID NO: 23827 - protein, 879 aa, Homo sapiens
  ENSP00000363924
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQWPQREESLPRLCLLLRPRG

SEQ ID NO: 23828 - protein, 1271 aa, Homo sapiens
  ENSP00000398796
MAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 23829 - protein, 116 aa, Homo sapiens
  ENSP00000460202
MLTLCYLIARCIGRTRLAPGQQEFENAEGDEYAADLAQGSPATAAQNGPDVYVLPLTEVSLPMAKQPGRSVQLLKSTDVGRHSLLYLKEIGRGWFGKVFLGEVNSGISSAQVVVKE

SEQ ID NO: 23830 - protein, 500 aa, Homo sapiens
  ENSP00000268251
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 23831 - protein, 95 aa, Homo sapiens
  ENSP00000456392
MQLRGWQHAKGVPVPQGVMASMLLAQRLACSFQHSYRLLVPGSRHISQAAAKVDVEFDYDGPLMKTEVPGPRSQELMKQLNIIQNAEAVHFFCNY

SEQ ID NO: 23832 - protein, 31 aa, Homo sapiens
  ENSP00000455184
MASMLLAQRLACSFQHSYRLLVPGSRHISQA

SEQ ID NO: 23833 - protein, 65 aa, Homo sapiens
  ENSP00000456267
MASMLLAQRLACSFQHSYRLLVPGSRHISQAAAKVDVEFDYDGPLMKTEVPGPRSQELMKQLNII

SEQ ID NO: 23834 - protein, 53 aa, Homo sapiens
  ENSP00000455198
MASMLLAQRLACSFQHSYRLLVPGVNETAEYNSECRGCAFFLQLRREPRQLPG

SEQ ID NO: 23835 - protein, 91 aa, Homo sapiens
  ENSP00000454415
MASMLLAQRLACSFQHSYRLLVPGSNPGSRHISQAAAKVDVEFDYDGPLMKTEVPGPRSQELMKQLNIIQNAEAVHFFCNYEESRGNYLVD

SEQ ID NO: 23836 - protein, 515 aa, Homo sapiens
  ENSP00000456330
MWWQHAKGVPVPQGVMASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 23837 - protein, 500 aa, Homo sapiens; identical to SEQ ID NO: 23830
  ENSP00000411916

SEQ ID NO: 23838 - protein, 515 aa, Homo sapiens
  ENSP00000454963
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKALPACDFEKPRSSPTSCLFQVWCWVAVVTNPFVSVPRWSSGITTLTCSSIFSVTS

SEQ ID NO: 23839 - protein, 117 aa, Homo sapiens
  ENSP00000455502
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIESHCHPGWSAVA

SEQ ID NO: 23840 - protein, 500 aa, Homo sapiens; identical to SEQ ID NO: 23830
  ENSP00000379845

SEQ ID NO: 23841 - protein, 123 aa, Homo sapiens
  ENSP00000363865
MPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVS

SEQ ID NO: 23842 - protein, 363 aa, Homo sapiens
  ENSP00000416623
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILMDVTCDDIAHGQLTVPRSAAVAATGDAKPNMMGRETLLSICASVPKVEFHERHILKHFSFCVCVSVSLFPAKGIVSFSWASFRIWVLWKAVFWQHGESMAVWEGQLGLGLNIAFEYFTSIDVG

SEQ ID NO: 23843 - protein, 2261 aa, Homo sapiens
  ENSP00000363868
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 23844 - protein, 1581 aa, Homo sapiens
  ENSP00000269080
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 23845 - protein, 1621 aa, Homo sapiens
  ENSP00000467271
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 23846 - protein, 702 aa, Homo sapiens
  ENSP00000467186
  MOD_RES (1)..(1): Any amino acid
XPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLEVNIYNLTIPDSPLSGISQITLLSAGILFLLSKPLHNKLTFGL

SEQ ID NO: 23847 - protein, 115 aa, Homo sapiens
  ENSP00000466126
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKE

SEQ ID NO: 23848 - protein, 1616 aa, Homo sapiens
  ENSP00000402814
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIQRVLLELEMKNIQDVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 23849 - protein, 156 aa, Homo sapiens
  ENSP00000481467
MLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILVTVELESQHC

SEQ ID NO: 23850 - protein, 277 aa, Homo sapiens
  ENSP00000361593
MASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGE

SEQ ID NO: 23851 - protein, 1492 aa, Homo sapiens
  ENSP00000361608
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 23852 - protein, 1464 aa, Homo sapiens
  ENSP00000244533
MCLLVFPLVPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDCGRLGAQIKWLLCSDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 23853 - protein, 129 aa, Homo sapiens
  ENSP00000422699
EEGIARKALYKLTAARADQGAEMEDRMSRQGQRTPSAQILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 23854 - protein, 62 aa, Homo sapiens
  ENSP00000435378
  MOD_RES (1)..(1): Any amino acid
XLPSSAWWTRSKGTSSLMALTSPNCRCTPCAHASPSSCRTPSSSAAPSGPGSLWKGIPHPWV

SEQ ID NO: 23855 - protein, 1581 aa, Homo sapiens
  ENSP00000374467
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 23856 - protein, 33 aa, Homo sapiens
  ENSP00000437233
  MOD_RES (1)..(1): Any amino acid
XRTGSGKSSFSLAFFRMVDTFEGPRPLQRHHPI

SEQ ID NO: 23857 - protein, 204 aa, Homo sapiens
  ENSP00000433638
  MOD_RES (1)..(1): Any amino acid
XQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLARPPAPSLIPKNWPDQGKIQIQNLSVRYDSSLKPVLKHVNALIAPGQKIGI

SEQ ID NO: 23858 - protein, 997 aa, Homo sapiens
  ENSP00000431653
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKRRQLRARRMTTCRPCCTSVLRSHGEPAPSTCPPPASCSCRCWSSHSCSSTWSWWPSTTGWPSGPTAP

SEQ ID NO: 23859 - protein, 53 aa, Homo sapiens
  ENSP00000434893
  MOD_RES (1)..(1): Any amino acid
XPSGPSGMRPGSSRSFSNTQTPTTLLPSSSQLPTDGWKSEWSTSVHVWCSSQR

SEQ ID NO: 23860 - protein, 1582 aa, Homo sapiens
  ENSP00000303960
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 23861 - protein, 50 aa, Homo sapiens
  ENSP00000483031
MPLAFCGSENHSAAYRVDQGVLNNGCFVDALNVVPHVFLLFITFPILFIG

SEQ ID NO: 23862 - protein, 611 aa, Homo sapiens
  ENSP00000426917
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMVCWSISQPLHLGCHGFSTSAFHDMDLRLCSIMNFWDKTSAQDSMQQETILVTMQHVLAKNIW

SEQ ID NO: 23863 - protein, 655 aa, Homo sapiens
  ENSP00000237612
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 23864 - protein, 150 aa, Homo sapiens
  ENSP00000426916
KRFRARRREEAVPATPTEIERRGKEAACGGTGKIKTLQMSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAP

SEQ ID NO: 23865 - protein, 130 aa, Homo sapiens
  ENSP00000426934
SDGDQTQLGQTRKIKTLQMSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAP

SEQ ID NO: 23866 - protein, 131 aa, Homo sapiens
  ENSP00000457882
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVIC

SEQ ID NO: 23867 - protein, 425 aa, Homo sapiens
  ENSP00000268129
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 23868 - protein, 55 aa, Homo sapiens
  ENSP00000454645
MNAMLETPELPAVFDGVKLAAVAAVLYVIVRCLNLKSPTAPPDLYFQDSGLSRFL

SEQ ID NO: 23869 - protein, 123 aa, Homo sapiens
  ENSP00000454531
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVG

SEQ ID NO: 23870 - protein, 425 aa, Homo sapiens; identical to SEQ ID NO: 23867
  ENSP00000455639

SEQ ID NO: 23871 - protein, 409 aa, Homo sapiens
  ENSP00000289119
MQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGGMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 23872 - protein, 356 aa, Homo sapiens
  ENSP00000462935
MQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 23873 - protein, 214 aa, Homo sapiens
  ENSP00000462578
MTFITPVTEIITYCSLQLQWPSKLFFPRMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 23874 - protein, 37 aa, Homo sapiens
  ENSP00000463996
  MOD_RES (1)..(1): Any amino acid
XYTDASPSPRLKSVGIPVLCLNSVDDVFSPSHGNLRS

SEQ ID NO: 23875 - protein, 136 aa, Homo sapiens
  ENSP00000463365
MQRLAMDLRMLSRELSLYLEHQVRVGFFGSGVGLSLILGFSVAYAFYYLSSIAKKRTTRRSGAGRVEDRPCLDLSSLRSPRCSTGMNLLKLQMEDRFHWTGLIMITVRVIWMPAPDLLSYCCLASREQARSHISFI

SEQ ID NO: 23876 - protein, 112 aa, Homo sapiens
  ENSP00000463848
  MOD_RES (1)..(1): Any amino acid
XVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLL

SEQ ID NO: 23877 - protein, 126 aa, Homo sapiens
  ENSP00000391582
MLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYP

SEQ ID NO: 23878 - protein, 349 aa, Homo sapiens
  ENSP00000390849
MAAEEEEVDSADTGERSGWLTGWLPTWCPTSISHLKEAEEKMLKCVPCTYKKEPVRISNGNKIWTLKFSHNISNKTPLVLLHGFGGGLGLWALNFGDLCTNRPVYAFDLLGFGRSSRPRFDSDAEEVENQFVESIEEWRCALGLDKMILLGHNLGGFLAAAYSLKYPSRVNHLILVEPWGFPERPDLADQDRPIPVWIRALGAALTPFNPLAGLRIAGPFGLSLVQRLRPDFKRKYSSMFEDDTVTEYIYHCNVQTPSGETAFKNMTIPYGWAKRPMLQRIGKMHPDIPVSVIFGARSCIDGNSGTSIQSLRPHSYVKTIAILGAGHYVYADQPEEFNQKVKEICDTVD

SEQ ID NO: 23879 - protein, 44 aa, Homo sapiens
  ENSP00000013894
MAAEEEEVDSADTGERSGWLTGWLPTWCPTSISHLKEAEEKMLK

SEQ ID NO: 23880 - protein, 45 aa, Homo sapiens
  ENSP00000412014
MLKCVPCTYKKEPVRISNGNKIWTLKFSHNISNKTPLVLLHGFGG

SEQ ID NO: 23881 - protein, 155 aa, Homo sapiens
  ENSP00000392159
RVNHLILVEPWGFPERPDLADQDRPIPVWIRALGAALTPFNPLAGLRIAGPFGLSLVQRLRPDFKRKYSSMFEDDTVTEYIYHCNVQTPSFSDLWRPILHRWQFWHQHPVLTTTFICEDNSYSWGRTLCICRSTRRIQPESKGDLRHCGLNTLKL

SEQ ID NO: 23882 - protein, 366 aa, Homo sapiens
  ENSP00000225941
MAELQQLQEFEIPTGREALRGNHSALLRVADYCEDNYVQATDKRKALEETMAFTTQALASVAYQVGNLAGHTLRMLDLQGAALRQVEARVSTLGQMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 23883 - protein, 360 aa, Homo sapiens
  ENSP00000406651
MAELQQLQEFEIPTGREALRGNHSALLRVADYCEDNYVQATDKRKALEETMAFTTQALASVAYQVGNLAGHTLRMLDLQGAALRQVEARMVNMHMEKVARREIGTLATVQRLPPGQKVIAPENLPPLTPYCRRPLNFGCLDDIGHGIKDLSTQLSRTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 23884 - protein, 160 aa, Homo sapiens
  ENSP00000460776
  MOD_RES (1)..(1): Any amino acid
XTGTLSRKSIKAPATPASATLGRPPRIPEPVHLPVVPDGRLSAASSAFSLASAGSAEGVGGAPTPKGQAAPPAPPLPSSLDPPPPPAAVEVFQRPPTLEELSPPPPAFLLFPQDEELPLPLDLPPPPPLDGDELGLPPPPPGFGPDEPSWVPASYLEKGT

SEQ ID NO: 23885 - protein, 191 aa, Homo sapiens
  ENSP00000459171
  MOD_RES (1)..(1): Any amino acid
XRPPRIPEPVHLPVVPDGRLSAASSAFSLASAGSAEGVGGAPTPKGQAAPPAPPLPSSLDPPPPPAAVEVFQRPPTLEELSPPPPAFLLFPQDEELPLPLDLPPPPPLDGDELGLPPPPPGFGPDEPSWVPASYLEKVVTLYPYTSQKDNELSFSEGTVICVTRRYSDGWCEGVSSEGTGFFPGNYVEPSC

SEQ ID NO: 23886 - protein, 1777 aa, Homo sapiens
  ENSP00000420524
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAAPKVPQRTHRPHPKPKTTLSPEELQTELVPATIFEPVSPIKEAPGTTFVPVTDLEPVTFRTEIPATTLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSVSVTGFEPVVHSTDAPGTTFALTELQTLILKPVTSPSLEMTESQPVSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 23887 - protein, 1075 aa, Homo sapiens
  ENSP00000284322
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 23888 - protein, 1131 aa, Homo sapiens
  ENSP00000418817
  MOD_RES (1)..(1): Any amino acid
XISLKPKIPLSPEVTHTKPAPEPQTLLPSQSTIGPETPGTKPSTTLALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLVPATILEPVLRTEASGTTAVPATIFEPVSPIKEAPGTTFVPVTDLEPVTFRTEIPATTLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSVSVTGFEPVVHSTDAPGTTFALTELQTLILKPVTSPSLEMTESQPVSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 23889 - protein, 233 aa, Homo sapiens
  ENSP00000419029
QRVTAKPKTSPSPEVSYTTPAPKDVLLPHKPYPEVSQSEPAPLETRGIPFIPMISPSPSQEELQTTLAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVK

SEQ ID NO: 23890 - protein, 189 aa, Homo sapiens
  ENSP00000420704
  MOD_RES (1)..(1): Any amino acid
XTAKPKTSPSPEVSYTTPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPRPTHPRRKPLPPNNVTGKPGSAGIISSGPITTPPLRS

SEQ ID NO: 23891 - protein, 307 aa, Homo sapiens
  ENSP00000418024
  MOD_RES (1)..(1): Any amino acid
XPKPKTTPHPEVPQTKLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKP

SEQ ID NO: 23892 - protein, 151 aa, Homo sapiens
  ENSP00000431537
  MOD_RES (1)..(1): Any amino acid
XVESITYVSEPPETTLETSPLPSQSITLPSPDEPQTEPAPKQTPRAPPKPKTSPRPRIPQTQPVPKVPQRVTAKPKTSPSPEVSYTTPAPKDVLLPHKPYPEVSQSEPVLQPVTFRFEPPKTTIAPLETRGIPFIPMISPSPSQEELQTTL

SEQ ID NO: 23893 - protein, 158 aa, Homo sapiens
  ENSP00000418800
VSDVLESVTLSTESPKETIAPAKTDYVYPTAKAPLWPEEPKTEVVESITYVSEPPETTLETSPLPSQSITLPSPDEPQTEPAPKQTPRAPPKPKTSPRPRIPQTQPVPKVPQRVTAKPKTSPSPEVSYTTPAPLETRGIPFIPMISPSPSQEELQTTL

SEQ ID NO: 23894 - protein, 187 aa, Homo sapiens
  ENSP00000417745
  MOD_RES (1)..(1): Any amino acid
XKTTPHPEVPQTKLAPKVPQRTHRPHPKPKTTLSPEELQTELVPATIFEPVSPIKEAPGTTFVPVTDLEPVTFRTEIPATTLATKTSKRTRPPRPRPKTTPSPQAPETKPAPKQTPRAPPKPKTSPRPRIPQTQPVPKVPQRVTAKPKTSPSPEVSYTTPAPLETRGIPFIPMISPSPSQEELQTTL

SEQ ID NO: 23895 - protein, 187 aa, Homo sapiens
  ENSP00000418063
  MOD_RES (1)..(1): Any amino acid
XFISLKPKIPLSPEVTHTKPAPKTSQRTRTRRPRPKHKTTPRPETLQTKLDFGPITPGTSSAPTTTTKRTRRPHPKPKTTPHPEVPQTKLAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTL

SEQ ID NO: 23896 - protein, 187 aa, Homo sapiens
  ENSP00000433981
PRKTKRPGRRPRPRPRPKTTPSPEVPKSKPALEPATIQPEPLVPTTASKPSERPKTTHRPDAPQIQPVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLAPKQTPRAPPKPKT

SEQ ID NO: 23897 - protein, 125 aa, Homo sapiens
  ENSP00000432069
  MOD_RES (1)..(1): Any amino acid
XKNETLALPAESKTPEVEKISARPTTVTPETVPRSTKPTTSSALDVSETTLAPKSLPEFPEAKTPFPFEKPRGTLASSEKPWIVPTAKISEDSKVLQPQTALTELQTLILKPVTSPSLEMTESQP

SEQ ID NO: 23898 - protein, 1005 aa, Homo sapiens
  ENSP00000433993
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQIQPGSKPPKQLLPKPQTTAEPDMPPTKSVSEPVPFETEAPSMTIVPTTDIEPVTVRTEATVTTLAPKTSQRTRTRRPRPKHKTTPRPETLQTKLDFGPITPGTSSAPTTTTKRTRRPHPKPKTTPHPEVPQTKLATKTSKRTRPPRPRPKTTPSPQAPETKPVPATVLEPVTLRPEASTTLASKTSQRTRRPRLRTKTTPRPEAPESKPVPTAELKPVTLRTETWVTTQAPKTSQRTRRPRPKTKTTPSPEVPQTKLVPSTDLEPGTLRTEAPKTMVVTTVLEPDTFRTKFPETTLAPKTQRTRRPRPRPKTTSSPEVPQNKSGKCMNPWLK

SEQ ID NO: 23899 - protein, 187 aa, Homo sapiens
  ENSP00000436070
  MOD_RES (1)..(1): Any amino acid
XRTTSAGTITPKISKSPEPTWTTPAPGKTQFISLKPKIPLSPEVTHTKPVPTTDIEPVTVRTEATVTTLAPKTSQRTRTRRPRPKHKTTPRPETLQTKLDFGPITPGTSSAPTTTTKRTRRPHPKPKTTPHPEVPQTKLAPKVPQRTHRPHPKPKTTLSPEELQTELVPATIFEPVSPIKEAPGTTF

SEQ ID NO: 23900 - protein, 150 aa, Homo sapiens
  ENSP00000437308
  MOD_RES (1)..(1): Any amino acid
XPETPGTKPSTTLAPRKTKRPGRRPRPRPRPKTTPSPEVPKSKPALEPATIQPEPLVPTTVPTTDIEPVTVRTEATVTTLAPKTSQRTRTRRPRPKHKTTPRPETLQTKLDFGPITPGTSSAPTTTTKRTRRPHPKPKTTPHPEVPQTKL

SEQ ID NO: 23901 - protein, 87 aa, Homo sapiens
  ENSP00000434425
  MOD_RES (1)..(1): Any amino acid
XQTLLPSQSTIGPETPGTKPSTTLAPRKTKRPGRRPRPRPRPKTTPSPEVPKSKPALEPATIQPEPLVPTTVSEPVPFETEAPSMTI

SEQ ID NO: 23902 - protein, 303 aa, Homo sapiens
  ENSP00000437031
  MOD_RES (1)..(1): Any amino acid
XTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPEPQTLLPSQSTIGPETPGTKPSTTLAPRKTKRPGRRPRPRPRPKTTPSPEVPKSKPALEPATIQPEPLVPTTASKPSERPKTTHRPDAPQI

SEQ ID NO: 23903 - protein, 84 aa, Homo sapiens
  ENSP00000417325
  MOD_RES (1)..(1): Any amino acid
XFEKPRGTLASSEKPWIVPTAKISEDSKVLQPQTATSDRILDSIPPKTSRTLEQPRATLAPSETPFVPQKLEIFTSPEMQPTTP

SEQ ID NO: 23904 - protein, 187 aa, Homo sapiens
  ENSP00000418479
  MOD_RES (1)..(1): Any amino acid
XNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLASSEKPWIVPTAKISEDSKVLQPQT

SEQ ID NO: 23905 - protein, 191 aa, Homo sapiens
  ENSP00000435319
CIVVLWYGWLHFYAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKA

SEQ ID NO: 23906 - protein, 161 aa, Homo sapiens
  ENSP00000436918
MRGGKCNMLSSLGCLLLCGSITLALGNAQKLPKDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVG

SEQ ID NO: 23907 - protein, 60 aa, Homo sapiens
  ENSP00000434256
MRGGKCNMLSSLGCLLLCGSITLALGNAQKLPKANKRTELVIQHGWMSLIKMMLNERSQV

SEQ ID NO: 23908 - protein, 455 aa, Homo sapiens
  ENSP00000376679
MFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 23909 - protein, 718 aa, Homo sapiens
  ENSP00000376682
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 23910 - protein, 401 aa, Homo sapiens
  ENSP00000358257
MFTEGEEMYLQGSTVWHPDCKQSTKTEEKLRAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 23911 - protein, 748 aa, Homo sapiens
  ENSP00000358260
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHDAAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 23912 - protein, 778 aa, Homo sapiens
  ENSP00000277895
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDYQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 23913 - protein, 172 aa, Homo sapiens
  ENSP00000414154
CKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRKPPIYKQHVLFEVILLLLI

SEQ ID NO: 23914 - protein, 173 aa, Homo sapiens
  ENSP00000400934
MFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPDQGINIYRK

SEQ ID NO: 23915 - protein, 718 aa, Homo sapiens
  ENSP00000433629
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 23916 - protein, 746 aa, Homo sapiens
  ENSP00000358256
MLMTLEMTELTDPHHTMGDYKVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKSCGKVLTGEYISKDGAPYCEKDYQGLFGVKCEACHQFITGKVLEAGDKHYHPSCARCSRCNQMFTEGEEMYLQGSTVWHPDCKQSTKTEEKLRLPNIRRSSSDFFYSKSLIRRTGRSPSLQPTRTSSESIYSRPGSSIPGSPGHTIYAKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGNEPSSGRNSPLPYRPDSRPLTPTYAQAPKHFHVPDQGINIYRKPPIYKQHAALAAQSKSSEDIIKFSKFPAAQAPDPSETPKIETDHWPGPPSFAVVGPDMKRRSSGREEDDEELLRRRQLQEEQLMKLNSGLGQLILKEEMEKESRERSSLLASRYDSPINSASHIPSSKTASLPGYGRNGLHRPVSTDFAQYNSYGDVSGGVRDFQTLPDGHMPAMRMDRGVSMPNMLEPKIFPYEMLMVTNRGRNKILREVDRTRLERHLAPEVFREIFGMSIQEFDRLPLWRRNDMKKKAKLF

SEQ ID NO: 23917 - protein, 401 aa, Homo sapiens [sequence omitted]

SEQ ID NO: 23918 - protein, 531 aa, Homo sapiens
  ENSP00000354887
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 23919 - protein, 346 aa, Homo sapiens
  ENSP00000423661
MFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 23920 - protein, 645 aa, Homo sapiens
  ENSP00000393511
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPSTYQQAPRHFHVPDTGVKDNIYRKPPIYRQHAARRSDGEDGSLDQDNRKQKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 23921 - protein, 611 aa, Homo sapiens
  ENSP00000342813
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 23922 - protein, 572 aa, Homo sapiens
  ENSP00000355003
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 23923 - protein, 521 aa, Homo sapiens
  ENSP00000384658
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAARRSDGEDGSLDQDNRKQKSSWLMLKGDADTRTNSPDLDTQSLSHSSGTDRDPLQRMAGDSFHSQYKIYPYDSLIVTNRIRVKLPKDVDRTRLERHLSPEEFQEVFGMSIEEFDRLALWKRNDLKKKALLF

SEQ ID NO: 23924 - protein, 559 aa, Homo sapiens
  ENSP00000421283
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGEGDQDDRSYKQCRTSSPSSTGSVSLGRYTPTSRSPQHYSRPAARRSDGEDGSLDQDNRKKSSWLMLKGDADTRTNSPDLDTQSLSHSSGTDRDPLQRMAGDSFHSRFPYSKSDPLPGHGKNGLDQRNANLAPCGADPDASWGMREYKIYPYDSLIVTNRIRVKLPKDVDRTRLERHLSPEEFQEVFGMSIEEFDRLALWKRNDLKKKALLF

SEQ ID NO: 23925 - protein, 470 aa, Homo sapiens
  ENSP00000389410
MSAVSQPQAAPSPLEKSPSTAILCNTCGNVCKGEVLRVQDKYFHIKCFVCKACGCDLAEGGFFVRQGEYICTLDYQRLYGTRCFSCDQFIEGEVVSALGKTYHPDCFVCAVCRLPFPPGDRVTFNGKECMCQKCSLPVSVGSSAHLSQGLRSCGGCGTEIKNGQALVALDKHWHLGCFKCKSCGKLLNAEYISKDGLPYCEADYHAKFGIRCDSCEKYITGRVLEAGEKHYHPSCALCVRCGQMFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAARRSDGEDGSLDQDNRKQKSSWLMLKGDADTRTNSPDLDTQSLSHSSGTDRDPLQRMAGDSFHSREWFF

SEQ ID NO: 23926 - protein, 305 aa, Homo sapiens
  ENSP00000421718
MFAEGEEMYLQGSSIWHPACRQAARTEDRNKETRTSSESIISVPASSTSGSPSRVIYAKLGGEILDYRDLAALPKSKAIYDIDRPDMISYSPYISHSAGDRQSYGESPQLLSPTPTEGDQDDRSYKQCRTSSPSSTGSVSLGRYTPTSRSPQHYSRPAGTVSVGTSSCLSLSQHPSPTSVFRHHYIPYFRGSESGRSTPSLSVLSDSKPPPSTYQQAPRHFHVPDTGVKDNIYRKPPIYRQHAARRSDGEDGSLDQDNRKKSSWLMLKGDADTRTNSPDLDTQSLSHSSGTDRDPLQRMAGDSFH

SEQ ID NO: 23927 - protein, 646 aa, Homo sapiens [sequence omitted]

SEQ ID NO: 23928 - protein, 588 aa, Homo sapiens
  ENSP00000315841
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 23929 - protein, 683 aa, Homo sapiens
  ENSP00000310309
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICAKVDNEILNYKDLAALPKVKSIYEVQRPDLISYEPHSRYMSDEMLERCGYGESLGTLSPYSQDIYENLDLRQRRASSPGYIDSPTYSRQGMSPTFSRSPHHYYRSGPESGRSSPYHSQLDVRSSTPTSYQAPKHFHIPAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 23930 - protein, 683 aa, Homo sapiens; identical to SEQ ID NO: 23929
  ENSP00000425394

SEQ ID NO: 23931 - protein, 151 aa, Homo sapiens
  ENSP00000421002
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRTSPGMESSSLPPALPSASPSLVNSASEAFPHWRQGDLQR

SEQ ID NO: 23932 - protein, 544 aa, Homo sapiens
  ENSP00000421183
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICDIYENLDLRQRRASSPGYIDSPTYSRQGMSPTFSRSPHHYYRSGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLEGNFWKSGCL

SEQ ID NO: 23933 - protein, 650 aa, Homo sapiens
  ENSP00000420855
MNTSIPYQQNPYNPRGSSNVIQCYRCGDTCKGEVVRVHNNHFHIRCFTCQVCGCGLAQSGFFFKNQEYICTQDYQQLYGTRCDSCRDFITGEVISALGRTYHPKCFVCSLCRKPFPIGDKVTFSGKECVCQTCSQSMASSKPIKIRGPSHCAGCKEEIKHGQSLLALDKQWHVSCFKCQTCSVILTGEYISKDGVPYCESDYHAQFGIKCETCDRYISGRVLEAGGKHYHPTCARCVRCHQMFTEGEEMYLTGSEVWHPICKQAARAEKKLKHRRTSETSISPPGSSIGSPNRVICAKVDNEILNYKDLAALPKVKSIYEVQRPDLISYEPHSRYMSDEMLERCGYGESLGTLSPYSQDIYENLDLRQRRASSPGYIDSPTYSRQGMSPTFSRSPHHYYRSAGDSNIYRKPPIYKRHGDLSTATKSKTSEDISQTSKYSPIYSPDPYYASESEYWTYHGSPKVPRARRFSSGGEEDDFDRSMHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 23934 - protein, 169 aa, Homo sapiens
  ENSP00000430150
MHKLQSGIGRLILKEEMKARSSSYADPWTPPRSSTSSREALHTAGYEMSLNGSPRSHYLADSDPLISKSASLPAYRRNGLHRTPSADLFHYDSMNAVNWGMREYKIYPYELLLVTTRGRNRLPKDVDRTRLERHLSQEEFYQVFGMTISEFDRLALWKRNELKKQARLF

SEQ ID NO: 23935 - protein, 170 aa, Homo sapiens [sequence omitted]

SEQ ID NO: 23936 - protein, 381 aa, Homo sapiens
  ENSP00000311436
MAPGEKESGEGPAKSALRKIRTATLVISLARGWQQWANENSIRQAQEPTGWLPGGTQDSPQAPKPITPPTSHQKAQSAPKSPPRLPEGHGDGQSSEKAPEVSHIKKKEVSKTVVSKTYERGGDVSHLSHRYERDAGVLEPGQPENDIDRILHSHGSPTRRRKCANLVSELTKGWRVMEQEEPTWRSDSVDTEDSGYGGEAEERPEQDGVQVAVVRIKRPLPSQVNRFTEKLNCKAQQKYSPVGNLKGRWQQWADEHIQSQKLNPFSEEFDYELAMSTRLHKGDEGYGRPKEGTKTAERAKRAEEHIYREMMDMCFIICTMARHRRDGKIQVTFGDLFDRYVRISDKVVGILMRARKHGLVDFEGEMLWQGRDDHVVITLLK

SEQ ID NO: 23937 - protein, 1025 aa, Homo sapiens
  ENSP00000410157
MAGTYSSTLKTLEDLTLDSGYGAGDSCRSLSLSSSKSNSQALNSSAQQHRGAAWWCYSGSMNSRHNSWDTVNTVLPEDPEVADLFSRCPRLPELEEFPWTEGDVARVLRKGAGGRRLPQFSAEAVRRLAGLLRRALIRVAREAQRLSVLHAKCTRFEVQSAVRLVHSWALAESCALAAVKALSLYSMSAGDGLRRGKSARCGLTFSVGRFFRWMVDTRISVRIHEYAAISLTACMENLVEEIRARVMASHSPDGGGAGGGEVSAEALEMVINNDAELWGVLQPYEHLICGKNANGVLSLPAYFSPYNGGSLGHDERADAYAQLELRTLEQSLLATCVGSISELSDLVSRAMHHMQGRHPLCPGASPARQARQPPQPITWSPDALHTLYYFLRCPQMESMENPNLDPPRMTLNNERPFMLLPPLMEWMRVAITYAEHRRSLTVDSGDIRQAARLLLPGLDCEPRQLKPEHCFSSFRRLDARAATEKFNQDLGFRMLNCGRTDLINQAIEALGPDGVNTMDDQGMTPLMYACAAGDEAMVQMLIDAGANLDIQVPSNSPRHPSIHPDSRHWTSLTFAVLHGHISVVQLLLDAGAHVEGSAVNGGEDSYAETPLQLASAAGNYELVSLLLSRGADPLLSMLEAHGMGSSLHEDMNCFSHSAAHGHRNVLRKLLTQPQQAKADVLSLEEILAEGVEESDASSQGSGSEGPVRLSRTRTKALQEAMYYSAEHGYVDITMELRALGVPWKLHIWIESLRTSFSQSRYSVVQSLLRDFSSIREEEYNEELVTEGLQLMFDILKTSKNDSVIQQLATIFTHCYGSSPIPSIPEIRKTLPARLDPHFLNNKEMSDVTFLVEGKLFYAHKVLLVTASNRFKTLMTNKSEQDGDSSKTIEISDMKYHIFQMMMQYLYYGGTESMEIPTTDILELLSAASLFQLDALQRHCEILCSQTLSMESAVNTYKYAKIHNAPELALFCEGFFLKHMKALLEQDAFRQLIYGRSSKVQGLDPLQDLQNTLAERVHSVYITSRV

SEQ ID NO: 23938 - protein, 415 aa, Homo sapiens
  ENSP00000281182
MLWSGCRRFGARLGCLPGGLRVLVQTGHRSLTSCIDPSMGLNEEQKEFQKVAFDFAAREMAPNMAEWDQKELFPVDVMRKAAQLGFGGVYIQTDVGGSGLSRLDTSVIFEALATGCTSTTAYISIHNMCAWMIDSFGNEEQRHKFCPPLCTMEKFASYCLTEPGSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 23939 - protein, 69 aa, Homo sapiens
  ENSP00000431532
MLWSGCRRFGARLGCLPGGLRVLVQTGHRSLTSCIDRAVPSGCDAEGSPARLRRGLHTNRCGRVWAVTS

SEQ ID NO: 23940 - protein, 76 aa, Homo sapiens
  ENSP00000431310
MLWSGCRRFGARLGCLPGGLRVLVQTGHRSLTSCIDPSMGLNEEQKEFQKVAFDFAAREMAPNMAEWDQKHVCLDD

SEQ ID NO: 23941 - protein, 288 aa, Homo sapiens
  ENSP00000363884
MLWSGCRRFGARLGCLPGGLRVLVQTGHRSLTSCIDRSGSDAASLLTSAKKQGDHYILNGSKAFISGAGESDIYVVMCRTGGPGPKGISCIVVEKGTPGLSFGKKEKKVGWNSQPTRAVIFEDCAVPVANRIGSEGQGFLIAVRGLNGGRINIASCSLGAAHASVILTRDHLNVRKQFGEPLASNQYLQFTLADMATRLVAARLMVRNAAVALQEERKDAVALCSMAKLFATDECFAICNQALQMHGGYGYLKDYAVQQYVRDSRVHQILEGSNEVMRILISRSLLQE

SEQ ID NO: 23942 - protein, 834 aa, Homo sapiens
  ENSP00000346733
MTVEFEECVKDSPRFRATIDEVETDVVEIEAKLDKLVKLCSGMVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRSLSSDSGLGGSSDGSSDVLAFGSGSVVDSVTEEEGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 23943 - protein, 52 aa, Homo sapiens
  ENSP00000347075
MTVEFEECVKDSPRFRAARGEQAAGAAFKAWGRPLTRWRRTWWRLRPNWTSW

SEQ ID NO: 23944 - protein, 759 aa, Homo sapiens
  ENSP00000321139
MVEAGKAYVSTSRLFVSGVRDLSQQCQGDTVISECLQRFADSLQEVVNYHMILFDQAQRSVRQQLQSFVKEDVRKFKETKKQFDKVREDLELSLVRNAQAPRHRPHEVEEATGALTLTRKCFRHLALDYVLQINVLQAKKKFEILDSMLSFMHAQSSFFQQGYSLLHQLDPYMKKLAAELDQLVIDSAVEKREMERKHAAIQQRTLLQDFSYDESKVEFDVDAPSGVVMEGYLFKRASNAFKTWNRRWFSIQNSQLVYQKKLKDALTVVVDDLRLCSVKPCEDIERRFCFEVLSPTKSCMLQADSEKLRQAWVQAVQASIASAYRESPDSCYSERLDRTASPSTSSIDSATDTRERGVKGESVLQRVQSVAGNSQCGDCGQPDPRWASINLGVLLCIECSGIHRSLGVHCSKVRSLTLDSWEPELLKLMCELGNSAVNQIYEAQCEGAGSRKPTASSSRQDKEAWIKDKYVEKKFLRKAPMAPALEAPRRWRVQKCLRPHSSPRAPTARRKVRLEPVLPCVAALSSVGTLDRKFRRDSLFCPDELDSLFSYFDAGAAGAGPRKGAESEESSGEADGDTEAEAWGLADVRELHPGLLAHRAARARDLPALAAALAHGAEVNWADAEDEGKTPLVQAVLGGSLIVCEFLLQNGADVNQRDSRGRAPLHHATLLGRTGQVCLFLKRGADQHALDQEQRDPLAIAVQAANADIVTLLRLARMAEEMREAEAAPGPPGALAGSPTELQFRRCIQEFISLHLEES

SEQ ID NO: 23945 - protein, 168 aa, Homo sapiens
  ENSP00000462995
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQISPTSWLPREATPCSCLPGRAGTTLRASR

SEQ ID NO: 23946 - protein, 1306 aa, Homo sapiens
  ENSP00000290866
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 23947 - protein, 314 aa, Homo sapiens
  ENSP00000462280
MDEGGCSQAAPAFAEGAGLGSGAPALSGSCLLTSGRCRCHRHRTALSIHPPLARPLFWSQFLLHHSHEADSLQKEEARLPQTKEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQ

SEQ ID NO: 23948 - protein, 119 aa, Homo sapiens
  ENSP00000463673
  MOD_RES (1)..(1): Any amino acid
XQAGSSRPWQEVLKDMVGLDALDAQPLLKYFQPVTQWLQEQNQQNGEVLGWPEYQWHPPLPDNYPEGIGDSHPWDKQPGNNQQPDNHPPGDGPPDISPEPKWDHAGEGQGARGGRGGAG

SEQ ID NO: 23949 - protein, 732 aa, Homo sapiens
  ENSP00000290863
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 23950 - protein, 145 aa, Homo sapiens
  ENSP00000462002
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILGLYDTWGSSLLCPCLDMCCLTAGIQGGCRRTCK

SEQ ID NO: 23951 - protein, 36 aa, Homo sapiens
  ENSP00000462110
MGQGWATAGLPSLLFLLLCYGHPLLVPSQEASQQTW

SEQ ID NO: 23952 - protein, 691 aa, Homo sapiens
  ENSP00000392247
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRTAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 23953 - protein, 208 aa, Homo sapiens
  ENSP00000462599
MGQGWATAGLPSLLFLLLCYGHPLLVPSQEASQQVTVTHGTSSQATTSSQTTTHQATAHQTSAQSPNLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPALKFSELPLQAEVS

SEQ ID NO: 23954 - protein, 36 aa, Homo sapiens; identical to SEQ ID NO: 23951
  ENSP00000464629

SEQ ID NO: 23955 - protein, 282 aa, Homo sapiens
  ENSP00000462909
LDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNEHDINFLMKMALDKIAFIPFSYLVDQWRWRVFDGSITKENYNQEWWSLRLKYQGLCPPVP

SEQ ID NO: 23956 - protein, 138 aa, Homo sapiens
  ENSP00000464428
  MOD_RES (1)..(1): Any amino acid
XRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSGTATHPTSSLGS

SEQ ID NO: 23957 - protein, 1242 aa, Homo sapiens
  ENSP00000397593
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSGTATHPTSSLGS

SEQ ID NO: 23958 - protein, 205 aa, Homo sapiens
  ENSP00000435733
MIIPPMFGAVQSVRDGLEKRYIASYLALTVVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRP

SEQ ID NO: 23959 - protein, 267 aa, Homo sapiens [sequence omitted]

SEQ ID NO: 23960 - protein, 51 aa, Homo sapiens
  ENSP00000432109
MAPAADREGYWGPTTSTLDWCEENYSVTWYIAEFCSFLPSSLKSNLKEYSE

SEQ ID NO: 23961 - protein, 80 aa, Homo sapiens
  ENSP00000432379
MAPAADREGYWGPTTSTLDWCEENYSVTWYIAEFWNTVSNLIMIIPPMFGAVQSVRDGLEKRYIASYLALTDGVSLCRRG

SEQ ID NO: 23962 - protein, 74 aa, Homo sapiens
  ENSP00000433368
MAPAADREGYWGPTTSTLDWCEENYSVTWYIAEFWNTVSNLIMIIPPMFGAVQSVRDGLEKRYIASYLALTAIG

SEQ ID NO: 23963 - protein, 71 aa, Homo sapiens
  ENSP00000435048
MAPAADREGYWGPTTSTLDWCEENYSVTWYIAEFCSFLPSSLKSNLKLVSTHQASFLVLGLWAGRGDIPVI

SEQ ID NO: 23964 - protein, 172 aa, Homo sapiens
  ENSP00000431149
MIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 23965 - protein, 230 aa, Homo sapiens
  ENSP00000436252
MAPAADREGYWGPTTSTLDWCEENYSVTWYIAEFLVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 23966 - protein, 51 aa, Homo sapiens; identical to SEQ ID NO: 23960
  ENSP00000431504

SEQ ID NO: 23967 - protein, 76 aa, Homo sapiens
  ENSP00000278544
MAPAADREGYWGPTTSTLDWCEENYSVTWYIAEFWNTVSNLIMIIPPMFGAVQSVRDGLEKRYIASYLALTEVLQI

SEQ ID NO: 23968 - protein, 526 aa, Homo sapiens
  ENSP00000403474
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 23969 - protein, 614 aa, Homo sapiens
  ENSP00000241069
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 23970 - protein, 614 aa, Homo sapiens; identical to SEQ ID NO: 23969
  ENSP00000414858

SEQ ID NO: 23971 - protein, 614 aa, Homo sapiens; identical to SEQ ID NO: 23969
  ENSP00000394976

SEQ ID NO: 23972 - protein, 397 aa, Homo sapiens
  ENSP00000397143
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQTRSTRRSASGRPSSTAGAPTWCTGRTSSTTTASRIAAQTCD

SEQ ID NO: 23973 - protein, 403 aa, Homo sapiens
  ENSP00000390004
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQGSQ

SEQ ID NO: 23974 - protein, 359 aa, Homo sapiens
  ENSP00000410380
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQGSQ

SEQ ID NO: 23975 - protein, 434 aa, Homo sapiens
  ENSP00000399725
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGTRSTRRSASGRPSSTAGAPTWCTGRTSSTTTASRIAAQTCD

SEQ ID NO: 23976 - protein, 55 aa, Homo sapiens
  ENSP00000415901
MRPPQCLLHTPSLASPLLLLLLWLLGGGVGAEGREDAELLVTVLRAPRCGTPTVS

SEQ ID NO: 23977 - protein, 617 aa, Homo sapiens
  ENSP00000404865
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATASEAPSTCPGFTHGEAAPRPGLPLPLLLLHQLLLLFLSHLRRL

SEQ ID NO: 23978 - protein, 158 aa, Homo sapiens
  ENSP00000396360
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGA

SEQ ID NO: 23979 - protein, 28 aa, Homo sapiens
  ENSP00000400933
MRPPQCLLHTPSLASPLLLLLLWLLGGG

SEQ ID NO: 23980 - protein, 617 aa, Homo sapiens; identical to SEQ ID NO: 23977
  ENSP00000303211

SEQ ID NO: 23981 - protein, 780 aa, Homo sapiens
  ENSP00000216254
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 23982 - protein, 805 aa, Homo sapiens
  ENSP00000379769
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVPSTIHCDHLIEAQVGGEKDLRRAKDINQEVYNFLATAGAKYGVGFWKPGSGIIHQIILENYAYPGVLLIGTDSHTPNGGGLGGICIGVGGADAVDVMAGIPWELKCPKVIGVKLTGSLSGWSSPKDVILKVAGILTVKGGTGAIVEYHGPGVDSISCTGEEGGQATWPLPCAGPDGSPVGSRSGMATICNMGAEIGATTSVFPYNHRMKKYLSKTGREDIANLADEFKDHLVPDPGCHYDQLIEINLSELKPHINGPFTPDLAHPVAEVGKVAEKEGWPLDIRVGLIGSCTNSSYEDMGRSAAVAKQALAHGLKCKSQFTITPGSEQIRATIERDGYAQILRDLGGIVLANACGPCIGQWDRKDIKKGEKNTIVTSYNRNFTGRNDANPETHAFVTSPEIVTALAIAGTLKFNPETDYLTGTDGKKFRLEAPDADELPKGEFDPGQDTYQHPPKDSSGQHVDVSPTSQRLQLLEPFDKWDGKDLEDLQILIKVKGKCTTDHISAAGPWLKFRGHLDNISNNLLIGAINIENGKANSVRNAVTQEFGPVPDTARYYKKHGIRWVVIGDENYGEGSSREHAALEPRHLGGRAIITKSFARIHETNLKKQGLLPLTFADPADYNKIHPVDKLTIQGLKDFTPGKPLKCIIKHPNGTQETILLNHTFNETQIEWFRAGSALNRMKELQQ

SEQ ID NO: 23983 - protein, 594 aa, Homo sapiens
  ENSP00000340260
MIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKVSYYNQATPGVLNYVTTNVAGLSSEFYTTFKACEQFLLDNRNDLAPSLQTL

SEQ ID NO: 23984 - protein, 607 aa, Homo sapiens
  ENSP00000360366
MIQNVGNHLRRGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKCCWVRVSLTELVSASGFYSWGLESRSKGRRSDGWNGKLAGGHLSTLKAIPVAKINSRFGYLQDT

SEQ ID NO: 23985 - protein, 338 aa, Homo sapiens
  ENSP00000476610
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 23986 - protein, 329 aa, Homo sapiens
  ENSP00000367073
MAFQLSRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 23987 - protein, 350 aa, Homo sapiens
  ENSP00000367076
MLLLRRSLSLNVLRKEVDRACFGEKAKQIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 23988 - protein, 380 aa, Homo sapiens
  ENSP00000367086
MKLLARALRLCEFGRQASSRRLVAGQGCVGPRRGCCAPVQVVGPRADLPPCGACITGRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 23989 - protein, 283 aa, Homo sapiens
  ENSP00000367091
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKAHVMPAGADHTAPSSSPSTGTKCSLLRHHHLGTHDLHEQ

SEQ ID NO: 23990 - protein, 246 aa, Homo sapiens
  ENSP00000402532
MSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKAP

SEQ ID NO: 23991 - protein, 370 aa, Homo sapiens
  ENSP00000354615
MARPGLIHSAPGLPDTCALLQPPAASAAAAPSMSGPDVETPSAIQICRIMRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQEGRSLPVPQLVPETEDEKKRFEEGKGRYLQMKAKRQGHAEPQP

SEQ ID NO: 23992 - protein, 279 aa, Homo sapiens
  ENSP00000465719
MRPDDANVAGNVHGGTILKMIEEAGAIISTRHCNSQNGERCVAALARVERTDFLSPMCIGEVAHVSAEITYTSKHSVEVQVNVMSENILTGAKKLTNKATLWYVPLSLKNVDKVLEVPPVVYSRQEQEEEGRKRYEAQKLERMETKWRNGDIVQPVLNPEPNTVSYSQSSLIHLVGPSDCTLHGFVHGGVTMKLMDEVAGIVAARHCKTNIVTASVDAINFHDKIRKGCVITISGRMTFTSNKSMEIEVLVDADPVVDSSQKRYRAASAFFTYVSLSQE

SEQ ID NO: 23993 - protein, 370 aa, Homo sapiens; identical to SEQ ID NO: 23991
  ENSP00000439218

SEQ ID NO: 23994 - protein, 724 aa, Homo sapiens
  ENSP00000258873
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 23995 - protein, 51 aa, Homo sapiens
  ENSP00000453605
MPRNSGAGYGCPHGDPSMLDSRETPQESRQDMIVRTTQEKLKTRSGNSCHI

SEQ ID NO: 23996 - protein, 482 aa, Homo sapiens
  ENSP00000453451
MANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 23997 - protein, 80 aa, Homo sapiens
  ENSP00000453447
MPRNSGAGYGCPHGDPSMLDSRETPQESRQDMIVRTTQEKLKTRGGAVDDSGRWAGAPAHRPQLPTASLHCASDVLRGPG

SEQ ID NO: 23998 - protein, 55 aa, Homo sapiens
  ENSP00000453585
MPRNSGAGYGCPHGDPSMLDSRETPQESRQDMIVRTTQEKLKTRDGVLLHCPGWP

SEQ ID NO: 23999 - protein, 138 aa, Homo sapiens
  ENSP00000454188
MFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMAN

SEQ ID NO: 24000 - protein, 243 aa, Homo sapiens
  ENSP00000453547
MPEVLLLRSASSILRTAFLSRWLPGGPRCVHKLSFVRNLQCRQGVRLNVRSSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIY

SEQ ID NO: 24001 - protein, 181 aa, Homo sapiens
  ENSP00000453800
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKQAHSVAILGFNSPEWFFSAVGTVFAGGIVT

SEQ ID NO: 24002 - protein, 208 aa, Homo sapiens
  ENSP00000460112
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLR

SEQ ID NO: 24003 - protein, 579 aa, Homo sapiens
  ENSP00000327916
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNPDVREKWKHQTGVELYEGYGQSETVVICANPKGMKIKSGSMGKASPPYDVQIVDDEGNVLPPGEEGNVAVRIRPTRPFCFFNCYLDNPEKTAASEQGDFYITGDRARMDKDGYFWFMGRNDDVINSSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 24004 - protein, 74 aa, Homo sapiens
  ENSP00000478073
MRPWLRHLVLQALRNSRAFCGSHGKPAPLPVPQKIVATWEAISLGRQLVPEYFNFAHDVLDVWSRLEEVKPVLS

SEQ ID NO: 24005 - protein, 112 aa, Homo sapiens
  ENSP00000461752
HNCMRTKSRDPLAIYFTSGTTGAPKMVEHSQSSYGLGFVASGRRWVALTESDIFWNTTDTGWVKAAWTLFSAWPNGSCIFVHELPRVDAKVILNVPVSEPEALSDRRRGPQP

SEQ ID NO: 24006 - protein, 689 aa, Homo sapiens [sequence omitted]

SEQ ID NO: 24007 - protein, 153 aa, Homo sapiens
  ENSP00000365916
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYSPWLQMPCGP

SEQ ID NO: 24008 - protein, 575 aa, Homo sapiens
  ENSP00000388793
MAARTLGRGVGRLLGSLRGLSGQPARPPCGVSAPRRAASGPSGSAPAVAAAAAQPGSYPALSAQAAREPAAFWGPLARDTLVWDTPYHTVWDCDFSTGKIGWFLGGQLNVSVNCLDQHVRKSPESVALIWERDEPGTEVRITYRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINILQIVGFFREAIRNSGDLLEH

SEQ ID NO: 24009 - protein, 568 aa, Homo sapiens
  ENSP00000439304
MRRRKERQPWDRFHFLHFAPHGRELLETTCRLANTLKRHGVHRGDRVAIYMPVSPLAVAAMLACARIGAVHTVIFAGFSAESLAGRINDAKCKVVITFNQGLRGGRVVELKKIVDEAVKHCPTVQHVLVAHRTDNKVHMGDLDVPLEQEMAKEDPVCAPESMGSEDMLFMLYTSGSTGMPKGIVHTQAGYLLYAALTHKLVFDHQPGDIFGCVADIGWITGHSYVVYGPLCNGATSVLFESTPVYPNAGRYWETVERLKINQFYGAPTAVRLLLKYGDAWVKKYDRSSLRTLGSVGEPINCEAWEWLHRVVGDSRCTLVDTWWQTETGGICIAPRPSEEGAEILPAMAMRPFFGIVPVLMDEKGSVVEGSNVSGALCISQAWPGMARTIYGDHQRFVDAYFKAYPGYYFTGDGAYRTEGGYYQITGRMDDVINISGHRLGTAEIEDAIADHPAVPESAVIGYPHDIKGEAAFAFIVVKDSAGDSDVVVQELKSMVATKIAKYAVPDEILVVKRLPKTRSGKVMRRLLRKIITSEAQELGDTTTLEDPSIIAEILSVYQKCKDKQAAAK

SEQ ID NO: 24010 - protein, 93 aa, Homo sapiens
  ENSP00000447748
MLNICYNAVDRHIENGKGDKIAIIYDSPVTNTKATFTYKEVLEQVSKLAGVLVKHGIKKGDTVVIYMPMIPQAMYTMLACARIGAIHSLIFGG

SEQ ID NO: 24011 - protein, 686 aa, Homo sapiens
  ENSP00000449535
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 24012 - protein, 685 aa, Homo sapiens
  ENSP00000261206
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 24013 - protein, 75 aa, Homo sapiens
  ENSP00000449507
  MOD_RES (1)..(1): Any amino acid
XLAEHGVAALFTAPTAIRAIRQQDPGAALGKQYSLTRFKTLFVAGERCDVETLEWSKNVFRVPVLDHWWQTGIKH

SEQ ID NO: 24014 - protein, 375 aa, Homo sapiens
  ENSP00000349960
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 24015 - protein, 125 aa, Homo sapiens
  ENSP00000409264
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQDSLL

SEQ ID NO: 24016 - protein, 163 aa, Homo sapiens
  ENSP00000407473
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTV

SEQ ID NO: 24017 - protein, 102 aa, Homo sapiens
  ENSP00000393951
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHP

SEQ ID NO: 24018 - protein, 99 aa, Homo sapiens
  ENSP00000399487
MLTMDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRV

SEQ ID NO: 24019 - protein, 80 aa, Homo sapiens
  ENSP00000401032
MDDDIAALVVDNGSGMCKAGFAGDDAPRAVFPSIVGRPRHQGVMVGMGQKDSYVGDEAQSKRGILTLKYPIEHGIVTNWD

SEQ ID NO: 24020 - protein, 376 aa, Homo sapiens
  ENSP00000416706
MTDNELSALVVDNGSGMCKAGFGGDDAPRAVFPSMIGRPRHQGVMVGMGQKDCYVGDEAQSKRGVLTLKYPIEHGVVTNWDDMEKIWYHTFYNELRVAPDEHPILLTEAPLNPKINREKMTQIMFEAFNTPAMYVAIQAVLSLYASGRTTGIVMDSGDGVTHIVPIYEGYALPHAILRLDLAGRDLTDYLMKILTERGYNFTTTAEREIVRDVKEKLCYVALDFEQEMVRAAASSSPERSYELPDGQVITIGNERFRCPEAIFQPSFLGIESSGIHETTFNSIMKCDVDIRKDLYANTVLSGGSTMYPGIADRMQKEIITLAPSTMKIKIIAPPERKYSVWIGGSILASLSTFQQMWISKQEYDEAGPPIVHRKCF

SEQ ID NO: 24021 - protein, 377 aa, Homo sapiens
  ENSP00000290378
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 24022 - protein, 426 aa, Homo sapiens
  ENSP00000160382
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 24023 - protein, 66 aa, Homo sapiens
  ENSP00000420151
MSPLKNGMIEDWECFRAILDHTYSKHVKSEPNLHPVLMSEAPWNTRAKREKLTELMFEQYNIPAFF

SEQ ID NO: 24024 - protein, 894 aa, Homo sapiens
  ENSP00000355537
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 24025 - protein, 686 aa, Homo sapiens
  ENSP00000438384
MTYVSCFYHAFAGAEQVRQSLKAHSALWKDPPPESSTCSYQEMRRSSVNSSAMAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 24026 - protein, 894 aa, Homo sapiens
  ENSP00000443495
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDLVYTARPDERAIMTYVSCYYHAFAGAQKAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 24027 - protein, 348 aa, Homo sapiens
  ENSP00000367007
MAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKPEFFQVCHTKKDYEEYGPSICRHNPVFGVMS

SEQ ID NO: 24028 - protein, 418 aa, Homo sapiens
  ENSP00000256001
MAGSLPPCVVDCGTGYTKLGYAGNTEPQFIIPSCIAIRESAKVVDQAQRRVLRGVDDLDFFIGDEAIDKPTYATKWPIRHGIIEDWDLMERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 24029 - protein, 330 aa, Homo sapiens
  ENSP00000380452
MERFMEQVVFKYLRAEPEDHYFLMTEPPLNTPENREYLAEIMFESFNVPGLYIAVQAVLALAASWTSRQVGERTLTGIVIDSGDGVTHVIPVAEGYVIGSCIKHIPIAGRDITYFIQQLLREREVGIPPEQSLETAKAIKEKYCYICPDIVKEFAKYDVDPRKWIKQYTGINAINQKKFVIDVGYERFLGPEIFFHPEFANPDFMESISDVVDEVIQNCPIDVRRPLYKNVVLSGGSTMFRDFGRRLQRDLKRVVDARLRLSEELSGGRIKPKPVEVQVVTHHMQRYAVWFGGSMLASTPEFFQVCHTKKDYEEYGPSICRHNPVFGVMS

SEQ ID NO: 24030 - protein, 769 aa, Homo sapiens
  ENSP00000200557
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 24031 - protein, 241 aa, Homo sapiens
  ENSP00000347856
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRSAGATLQCTVKPSMWS

SEQ ID NO: 24032 - protein, 569 aa, Homo sapiens
  ENSP00000443773
MQGTRLPVCCACPVGSSKPAEAEKEKVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 24033 - protein, 517 aa, Homo sapiens
  ENSP00000465537
LLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQPQQGRAVWLPPLCQHLWSSSARGPGGRHQ

SEQ ID NO: 24034 - protein, 909 aa, Homo sapiens
  ENSP00000357668
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 24035 - protein, 738 aa, Homo sapiens
  ENSP00000357665
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQAEARQEAAESNRERGQGQEPVGSQEHASTASLTLI

SEQ ID NO: 24036 - protein, 278 aa, Homo sapiens
  ENSP00000391268
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFT

SEQ ID NO: 24037 - protein, 272 aa, Homo sapiens
  ENSP00000428376
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKVRPVLPILEHPDCSRGLGSVDPREHV

SEQ ID NO: 24038 - protein, 489 aa, Homo sapiens
  ENSP00000431027
  MOD_RES (1)..(1): Any amino acid
XDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKRVWKTCNLKTGDQFQSQ

SEQ ID NO: 24039 - protein, 918 aa, Homo sapiens
  ENSP00000257527
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKFPEYRSQRAGGMISSKI

SEQ ID NO: 24040 - protein, 955 aa, Homo sapiens
  ENSP00000428654
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKVSPREALKVKAGTRGLQGGRCRVEKTKQFMLLVVWTELPEQKPRAKHSCFLVPA

SEQ ID NO: 24041 - protein, 590 aa, Homo sapiens
  ENSP00000470501
MGPTSVLRAGLTPSCLPPPSGATNGSVSPLGRAQRVWTEPGGRGLHGATAAGPVAAACPLLAVTATAPGQPSGASTVWVREGGTAPATRMTVPLAPRTSEKCSVLNLTASLSVGNSTSGKRTGEACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 24042 - protein, 289 aa, Homo sapiens
  ENSP00000469901
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVRLPNFSRTRVWEAPLTSS

SEQ ID NO: 24043 - protein, 1103 aa, Homo sapiens
  ENSP00000471851
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 24044 - protein, 289 aa, Homo sapiens; identical to SEQ ID NO: 24042
  ENSP00000469559

SEQ ID NO: 24045 - protein, 126 aa, Homo sapiens
  ENSP00000469516
MGPTSVLRAGLTPSCLPPPSGATNGSVSPLGRAQRVWTEPGGRGLHGATAAGPVAAACPLLAVTATAPGQPSGASTVWVREGGTAPATRMTVPLAPRTSEKCSVLNLTASLSVGNSTSGKRTGEGA

SEQ ID NO: 24046 - protein, 1103 aa, Homo sapiens; identical to SEQ ID NO: 24043
  ENSP00000270328

SEQ ID NO: 24047 - protein, 950 aa, Homo sapiens
  ENSP00000299164
MLLLGILTLAFAGRTAGGSEPEREVVVPIRLDPDINGRRYYWRGPEDSGDQGLIFQITAFQEDFYLHLTPDAQFLAPAFSTEHLGVPLQGLTGGSSDLRRCFYSGDVNAEPDSFAAVSLCGGLRGAFGYRGAEYVISPLPNASAPAAQRNSQGAHLLQRRGVPGGPSGDPTSRCGVASGWNPAILRALDPYKPRRAGFGESRSRRRSGRAKRFVSIPRYVETLVVADESMVKFHGADLEHYLLTLLATAARLYRHPSILNPINIVVVKVLLLRDRDSGPKVTGNAALTLRNFCAWQKKLNKVSDKHPEYWDTAILFTRQDLCGATTCDTLGMADVGTMCDPKRSCSVIEDDGLPSAFTTAHELGHVFNMPHDNVKVCEEVFGKLRANHMMSPTLIQIDRANPWSACSAAIITDFLDSGHGDCLLDQPSKPISLPEDLPGASYTLSQQCELAFGVGSKPCPYMQYCTKLWCTGKAKGQMVCQTRHFPWADGTSCGEGKLCLKGACVERHNLNKHRVDGSWAKWDPYGPCSRTCGGGVQLARRQCTNPTPANGGKYCEGVRVKYRSCNLEPCPSSASGKSFREEQCEAFNGYNHSTNRLTLAVAWVPKYSGVSPRDKCKLICRANGTGYFYVLAPKVVDGTLCSPDSTSVCVQGKCIKAGCDGNLGSKKRFDKCGVCGGDNKSCKKVTGLFTKPMHGYNFVVAIPAGASSIDIRQRGYKGLIGDDNYLALKNSQGKYLLNGHFVVSAVERDLVVKGSLLRYSGTGTAVESLQASRPILEPLTVEVLSVGKMTPPRVRYSFYLPKEPREDKSSHPKDPRGPSVLHNSVLSLSNQVEQPDDRPPARWVAGSWGPCSASCGSGLQKRAVDCRGSAGQRTVPACDAAHRPVETQACGEPCPTWELSAWSPCSKSCGRGFQRRSLKCVGHGGRLLARDQCNLHRKPQELDFCVLRPC

SEQ ID NO: 24048 - protein, 570 aa, Homo sapiens
  ENSP00000421631
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMVRS

SEQ ID NO: 24049 - protein, 1224 aa, Homo sapiens
  ENSP00000274181
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMWCRGGQCVKYGDEGPKPTHGHWSDWSSWSPCSRTCGGGVSHRSRLCTNPKPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGGQMTVREGCYRDLKFQVNMSFCNPKTRPVTGLVPCKVSACPPSWSVGNWSACSRTCGGGAQSRPVQCTRRVHYDSEPVPASLCPQPAPSSRQACNSQSCPPAWSAGPWAECSHTCGKGWRKRAVACKSTNPSARAQLLPDAVCTSEPKPRMHEACLLQRCHKPKKLQWLVSAWSQCSVTCERGTQKRFLKCAEKYVSGKYRELASKKCSHLPKPSLELERACAPLPCPRHPPFAAAGPSRGSWFASPWSQCTASCGGGVQTRSVQCLAGGRPASGCLLHQKPSASLACNTHFCPIAEKKDAFCKDYFHWCYLVPQHGMCSHKFYGKQCCKTCSKSNL

SEQ ID NO: 24050 - protein, 1095 aa, Homo sapiens
  ENSP00000268070
MCDGALLPPLVLPVLLLLVWGLDPGTAVGDAAADVEVVLPWRVRPDDVHLPPLPAAPGPRRRRRPRTPPAAPRARPGERALLLHLPAFGRDLYLQLRRDLRFLSRGFEVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTEKKKPTWGRPSRDWRERRNAIRLTSEHTVETLVVADADMVQYHGAEAAQRFILTVMNMVYNMFQHQSLGIKINIQVTKLVLLRQRPAKLSIGHHGERSLESFCHWQNEEYGGARYLGNNQVPGGKDDPPLVDAAVFVTRTDFCVHKDEPCDTVGIAYLGGVCSAKRKCVLAEDNGLNLAFTIAHELGHNLGMNHDDDHSSCAGRSHIMSGEWVKGRNPSDLSWSSCSRDDLENFLKSKVSTCLLVTDPRSQHTVRLPHKLPGMHYSANEQCQILFGMNATFCRNMEHLMCAGLWCLVEGDTSCKTKLDPPLDGTECGADKWCRAGECVSKTPIPEHVDGDWSPWGAWSMCSRTCGTGARFRQRKCDNPPPGPGGTHCPGASVEHAVCENLPCPKGLPSFRDQQCQAHDRLSPKKKGLLTAVVVDDKPCELYCSPLGKESPLLVADRVLDGTPCGPYETDLCVHGKCQKIGCDGIIGSAAKEDRCGVCSGDGKTCHLVKGDFSHARGTALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGGERRTIVSCTRIVNKTTTLVNDSDCPQASRPEPQVRRCNLHPCQSRWVAGPWSPCSATCEKGFQHREVTCVYQLQNGTHVATRPLYCPGPRPAAVQSCEGQDCLSIWEASEWSQCSASCGKGVWKRTVACTNSQGKCDASTRPRAEEACEDYSGCYEWKTGDWSTCSSTCGKGLQSRVVQCMHKVTGRHGSECPALSKPAPYRQCYQEVCNDRINANTITSPRLAALTYKCTRDQWTVYCRVIREKNLCQDMRWYQRCCQTCRDFYANKMRQPPPNS

SEQ ID NO: 24051 - protein, 214 aa, Homo sapiens
  ENSP00000456161
  MOD_RES (1)..(1): Any amino acid
XELYCSPLGKESPLLVADRVLDGTPCGPYETDLCVHGKCQKIGCDGIIGSAAKEDRCGVCSGDGKTCHLVKGDFSHARGTGYIEAAVIPAGARRIRVVEDKPAHSFLALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGG

SEQ ID NO: 24052 - protein, 68 aa, Homo sapiens
  ENSP00000453604
MCDGALLPPLVLPVLLLLVWGLDPGTGWPHSAWAGAGANPAPQQLPGPIQWTRTSDQAQMVLDPQPFC

SEQ ID NO: 24053 - protein, 120 aa, Homo sapiens
  ENSP00000458005
  MOD_RES (1)..(1): Any amino acid
XGRPAELCFYSGRVLGHPGSLVSLSACGAAGGLVGLIQLGQEQVLIQPLNNSQGPFSGREHLIRRKWSLTPSPSAEAQRPEQLCKVLTVPQCLGLTWEDLKSGGWSDLEVPHSCVWPGGG

SEQ ID NO: 24054 - protein, 62 aa, Homo sapiens
  ENSP00000454368
  MOD_RES (1)..(1): Any amino acid
XQGRPSSSCLLHQKPPVLRACNTNFCPAPEKRDSAGSQLPCCDGPQAVHEEGLRFPDNHWAM

SEQ ID NO: 24055 - protein, 1221 aa, Homo sapiens
  ENSP00000282849
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKYAPKPPTEDTYLRFDEYGSSGRPRRSAGKSQKGLNVETLVVADKKMVEKHGKGNVTTYILTVMNMVSGLFKDGTIGSDINVVVVSLILLEQEPGGLLINHHADQSLNSFCQWQSALIGKNGKRHDHAILLTGFDICSWKNEPCDTLGFAPISGMCSKYRSCTINEDTGLGLAFTIAHESGHNFGMIHDGEGNPCRKAEGNIMSPTLTGNNGVFSWSSCSRQYLKKFLSTPQAGCLVDEPKQAGQYKYPDKLPGQIYDADTQCKWQFGAKAKLCSLGFVKDICKSLWCHRVGHRCETKFMPAAEGTVCGLSMWCRQGQCVKFGELGPRPIHGQWSAWSKWSECSRTCGGGVKFQERHCNNPKPQYGGLFCPGSSRIYQLCNINPCNENSLDFRAQQCAEYNSKPFRGWFYQWKPYTKVEEEDRCKLYCKAENFEFFFAMSGKVKDGTPCSPNKNDVCIDGVCELVGCDHELGSKAVSDACGVCKGDNSTCKFYKGLYLNQHKANEYYPVVLIPAGARSIEIQELQVSSSYLAVRSLSQKYYLTGGWSIDWPGEFPFAGTTFEYQRSFNRPERLYAPGPTNETLVFEILMQGKNPGIAWKYALPKVMNGTPPATKRPAYTWSIVQSECSVSCGGGYINVKAICLRDQNTQVNSSFCSAKTKPVTEPKICNAFSCPAYWMPGEWSTCSKACAGGQQSRKIQCVQKKPFQKEEAVLHSLCPVSTPTQVQACNSHACPPQWSLGPWSQCSKTCGRGVRKRELLCKGSAAETLPESQCTSLPRPELQEGCVLGRCPKNSRLQWVASSWSECSATCGLGVRKREMKCSEKGFQGKLITFPERRCRNIKKPNLDLEETCNRRACPAHPVYNMVAGWYSLPWQQCTVTCGGGVQTRSVHCVQQGRPSSSCLLHQKPPVLRACNTNFCPAPEKREDPSCVDFFNWCHLVPQHGVCNHKFYGKQCCKSCTRKI

SEQ ID NO: 24056 - protein, 274 aa, Homo sapiens
  ENSP00000392540
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKCICSQASHRGHLSKV

SEQ ID NO: 24057 - protein, 185 aa, Homo sapiens
  ENSP00000457395
  MOD_RES (1)..(1): Any amino acid
XVDSAGSYISHDILHNGRKKRSAQNARSSLHYRFSAFGQELHLELKPSAILSSHFIVQVLGKDGASETQKPEVQQCFYQGFIRNDSSSSVAVSTCAGLLLAQEHNYSSPAGHHPHVLYKRTAEEKIQRYRGYPGSGRNYPGYSPSHIPHASQSRETEYHHRRLQKQHFCGRRKKCICSQASHRGH

SEQ ID NO: 24058 - protein, 1211 aa, Homo sapiens
  ENSP00000251582
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 24059 - protein, 106 aa, Homo sapiens
  ENSP00000489888
VTCGNGTQERPVLCRTADDSFGICQEERPETARTCRLGPCPRNISDPSKKSYVVQWLSRPDPDSPIRKISSSNRPVYNSASALQCMPCALWSLPWAPLLSVYGKLP

SEQ ID NO: 24060 - protein, 566 aa, Homo sapiens
  ENSP00000274609
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKFRPGAVAHACYPSTLGGQGRWIA

SEQ ID NO: 24061 - protein, 1211 aa, Homo sapiens; identical to SEQ ID NO: 24058
  ENSP00000492346

SEQ ID NO: 24062 - protein, 106 aa, Homo sapiens; identical to SEQ ID NO: 24059
  ENSP00000491140

SEQ ID NO: 24063 - protein, 566 aa, Homo sapiens; identical to SEQ ID NO: 24060
  ENSP00000492365

SEQ ID NO: 24064 - protein, 1117 aa, Homo sapiens
  ENSP00000370443
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCGTKGHEAAKLMAAHITANTNPFSWSACSRDYITSFLDSGRGTCLDNEPPKRDFLYPAVAPGQVYDADEQCRFQYGATSRQCKYGEVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGDGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGVQRQEVVCKRLDDNSIVQNNYCDPDSKPPENQRACNTEPCPPEWFIGDWLECSKTCDGGMRTRAVLCIRKIGPSEEETLDYSGCLTHRPVEKEPCNNQSCPPQWVALDWSECTPKCGPGFKHRIVLCKSSDLSKTFPAAQCPEESKPPVRIRCSLGRCPPPRWVTGDWGQCSAQCGLGQQMRTVQCLSYTGQASSDCLETVRPPSMQQCESKCDSTPISNTEECKDVNKVAYCPLVLKFKFCSRAYFRQMCCKTCQGH

SEQ ID NO: 24065 - protein, 292 aa, Homo sapiens
  ENSP00000424377
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVRLPNFTVIPA

SEQ ID NO: 24066 - protein, 1686 aa, Homo sapiens
  ENSP00000373472
MPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAEKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQLLFQESNPGVHYEYTIHREAGGHDEVPPPVFSWHYGPWTKCTVTCGRGVQRQNVYCLERQAGPVDEEHCDPLGRPDDQQRKCSEQPCPARWWAGEWQLCSSSCGPGGLSRRAVLCIRSVGLDEQSALEPPACEHLPRPPTETPCNRHVPCPATWAVGNWSQCSVTCGEGTQRRNVLCTNDTGVPCDEAQQPASEVTCSLPLCRWPLGTLGPEGSGSGSSSHELFNEADFIPHHLAPRPSPASSPKPGTMGNAIEEEAPELDLPGPVFVDDFYYDYNFINFHEDLSYGPSEEPDLDLAGTGDRTPPPHSHPAAPSTGSPVPATEPPAAKEEGVLGPWSPSPWPSQAGRSPPPPSEQTPGNPLINFLPEEDTPIGAPDLGLPSLSWPRVSTDGLQTPATPESQNDFPVGKDSQSQLPPPWRDRTNEVFKDDEEPKGRGAPHLPPRPSSTLPPLSPVGSTHSSPSPDVAELWTGGTVAWEPALEGGLGPVDSELWPTVGVASLLPPPIAPLPEMKVRDSSLEPGTPSFPTPGPGSWDLQTVAVWGTFLPTTLTGLGHMPEPALNPGPKGQPESLSPEVPLSSRLLSTPAWDSPANSHRVPETQPLAPSLAEAGPPADPLVVRNAGWQAGNWSECSTTCGLGAVWRPVRCSSGRDEDCAPAGRPQPARRCHLRPCATWHSGNWSKCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSGPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 24067 - protein, 1935 aa, Homo sapiens
  ENSP00000418735
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 24068 - protein, 1907 aa, Homo sapiens
  ENSP00000295903
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 24069 - protein, 69 aa, Homo sapiens
  ENSP00000478086
AKCPQGRFSINLYGTGLSLTESARWISQGNYAVSDIKKSPDGTRVVGKCGGYCGKCTPSSGTGLEVRVL

SEQ ID NO: 24070 - protein, 991 aa, Homo sapiens
  ENSP00000417521
  MOD_RES (1)..(1): Any amino acid
XECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 24071 - protein, 488 aa, Homo sapiens
  ENSP00000419217
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLE

SEQ ID NO: 24072 - protein, 1691 aa, Homo sapiens
  ENSP00000286744
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 24073 - protein, 1682 aa, Homo sapiens
  ENSP00000456313
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDSTYTSQTATNKGAASHVKRDKPLEGS

SEQ ID NO: 24074 - protein, 877 aa, Homo sapiens
  ENSP00000358037
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKVSPEPPAISCILGNHAQDTSAFPA

SEQ ID NO: 24075 - protein, 1074 aa, Homo sapiens
  ENSP00000358034
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 24076 - protein, 1097 aa, Homo sapiens
  ENSP00000358035
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEAPLLPLRHAFFLLPGAGSGDSTGVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 24077 - protein, 1074 aa, Homo sapiens; identical to SEQ ID NO: 24075
  ENSP00000271643

SEQ ID NO: 24078 - protein, 701 aa, Homo sapiens
  ENSP00000436367
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 24079 - protein, 741 aa, Homo sapiens
  ENSP00000435381
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 24080 - protein, 714 aa, Homo sapiens
  ENSP00000374513
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEGSRSYTQAGVQWCNHGSLQPRPPGLLSDPSTSTFQGAGTTEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKVH

SEQ ID NO: 24081 - protein, 701 aa, Homo sapiens; identical to SEQ ID NO: 24078
  ENSP00000015877

SEQ ID NO: 24082 - protein, 141 aa, Homo sapiens
  ENSP00000387480
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRS

SEQ ID NO: 24083 - protein, 741 aa, Homo sapiens; identical to SEQ ID NO: 24079
  ENSP00000353920

SEQ ID NO: 24084 - protein, 741 aa, Homo sapiens; identical to SEQ ID NO: 24079
  ENSP00000414600

SEQ ID NO: 24085 - protein, 52 aa, Homo sapiens
  ENSP00000478160
MANEHTLIHPASIEDPLEARPMSDEDPEDEDALPARWKKEMGRKRKRTIATL

SEQ ID NO: 24086 - protein, 729 aa, Homo sapiens
  ENSP00000486475
MKIPRMKTPCQPDRNSLRQSRNPQKYFAMDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 24087 - protein, 739 aa, Homo sapiens
  ENSP00000370713
MASVLGSGRGSGGLSSQLKCKSKRRRRRRSKRKDKVSILSTFLAPFKHLSPGITNTEDDDTLSTSSAEVKENRNVGNLAARPPPSGDRARGGAPGAKRKRPLEEGNGGHLCKLQLVWKKLSWSVAPKNALVQLHELRPGLQYRTVSQTGPVHAPVFAVAVEVNGLTFEGTGPTKKKAKMRAAELALRSFVQFPNACQAHLAMGGGPGPGTDFTSDQADFPDTLFQEFEPPAPRPGLAGGRPGDAALLSAAYGRRRLLCRALDLVGPTPATPAAPGERNPVVLLNRLRAGLRYVCLAEPAERRARSFVMAVSVDGRTFEGSGRSKKLARGQAAQAALQELFDIQMPGHAPGRARRTPMPQEFADSISQLVTQKFREVTTDLTPMHARHKALAGIVMTKGLDARQAQVVALSSGTKCISGEHLSDQGLVVNDCHAEVVARRAFLHFLYTQLELHLSKRREDSERSIFVRLKEGGYRLRENILFHLYVSTSPCGDARLHSPYEITTDLHSSKHLVRKFRGHLRTKIESGEGTVPVRGPSAVQTWDGVLLGEQLITMSCTDKIARWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 24088 - protein, 248 aa, Homo sapiens
  ENSP00000370711
MGLWSPVPGNSVPRAPVMAGLGLGHSQGAPQGPHDGKTDRSSGPGRRRTERTRLPGLLGGAPLTAGSPHRWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 24089 - protein, 141 aa, Homo sapiens
  ENSP00000370706
MSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 24090 - protein, 338 aa, Homo sapiens
  ENSP00000392721
MYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKVQIHPSLSGLDVLLGFWSPTLQRGRLCT

SEQ ID NO: 24091 - protein, 1119 aa, Homo sapiens
  ENSP00000297323
MAGAPRGGGGGGGGAGEPGGAERAAGTSRRRGLRACDEEFACPELEALFRGYTLRLEQAATLKALAVLSLLAGALALAELLGAPGPAPGLAKGSHPVHCVLFLALLVVTNVRSLQVPQLQQVGQLALLFSLTFALLCCPFALGGPARGSAGAAGGPATAEQGVWQLLLVTFVSYALLPVRSLLAIGFGLVVAASHLLVTATLVPAKRPRLWRTLGANALLFVGVNMYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKRRALRTASEKLRNRSSFSTNVVYTTPGTRVNRYISRLLEARQTELEMADLNFFTLKYKHVEREQKYHQLQDEYFTSAVVLTLILAALFGLVYLLIFPQSVVVLLLLVFCICFLVACVLYLHITRVQCFPGCLTIQIRTVLCIFIVVLIYSVAQGCVVGCLPWAWSSKPNSSLVVLSSGGQRTALPTLPCESTHHALLCCLVGTLPLAIFFRVSSLPKMILLSGLTTSYILVLELSGYTRTGGGAVSGRSYEPIVAILLFSCALALHARQVDIRLRLDYLWAAQAEEEREDMEKVKLDNRRILFNLLPAHVAQHFLMSNPRNMDLYYQSYSQVGVMFASIPNFNDFYIELDGNNMGVECLRLLNEIIADFDELMEKDFYKDIEKIKTIGSTYMAAVGLAPTSGTKAKKSISSHLSTLADFAIEMFDVLDEINYQSYNDFVLRVGINVGPVVAGVIGARRPQYDIWGNTVNVASRMDSTGVQGRIQVTEEVHRLLRRCPYHFVCRGKVSVKGKGEMLTYFLEGRTDGNGSQIRSLGLDRKMCPFGRAGLQGRRPPVCPMPGVSVRAGLPPHSPGQYLPSAAAGKEA

SEQ ID NO: 24092 - protein, 338 aa, Homo sapiens; identical to SEQ ID NO: 24090
  ENSP00000479770

SEQ ID NO: 24093 - protein, 468 aa, Homo sapiens
  ENSP00000306620
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 24094 - protein, 447 aa, Homo sapiens
  ENSP00000387335
MAGVVHVSLAALLLLPMAPAMHSDCIFKKEQAMCLEKIQRANELMGFNDSSPGCPGMWDNITCWKPAHVGEMVLVSCPELFRIFNPDQDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 24095 - protein, 74 aa, Homo sapiens
  ENSP00000400893
MAGVVHVSLAALLLLPMAPAMHSDCIFKKEQAMCLEKIQRANELMGFNDSSPGCPGMWDNITCWKPAHVGEMVL

SEQ ID NO: 24096 - protein, 496 aa, Homo sapiens
  ENSP00000379514
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYFSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 24097 - protein, 524 aa, Homo sapiens
  ENSP00000386395
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLTNLSPRVPKKAREDPLPVPSDQHSLPFLSCVQKCYCKPQRAQQHSCKMSELSTITLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 24098 - protein, 147 aa, Homo sapiens
  ENSP00000416622
  MOD_RES (1)..(1): Any amino acid
XATLRLYFDDTGCWDMNDSTALWWVIKGPVVGSIMVNFVLFIGIIVILVQKLQSPDMGGNESSIYLTNLSPRVPKKAREDPLPVPSDQHSLPFLRLARSTLLLIPLFGIHYTVFAFSPENVSKRERLVFELGLGSFQGFVVAVLYCF

SEQ ID NO: 24099 - protein, 496 aa, Homo sapiens; identical to SEQ ID NO: 24096
  ENSP00000483721

SEQ ID NO: 24100 - protein, 726 aa, Homo sapiens
  ENSP00000384303
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDGEKETAPEEPGSPAKSAPASPVQSPAKEAETKSPLVSPSKSLEEGTKKTETSKAATTEPETTQPEGVVVNGREEEQTAEEILSKGLSQMTTSADTDVDTSKDKTESVTSGPMSPEGSPSKSPSKKKKKFRTPSFLKKSKKKEKVES

SEQ ID NO: 24101 - protein, 726 aa, Homo sapiens; identical to SEQ ID NO: 24100
  ENSP00000264436

SEQ ID NO: 24102 - protein, 726 aa, Homo sapiens; identical to SEQ ID NO: 24100
  ENSP00000384677

SEQ ID NO: 24103 - protein, 643 aa, Homo sapiens
  ENSP00000347972
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDETGQEREPGSGPAVCEFFSVALHIWSNILERKKLPQKSLAHLQSLHLLLQCRAQRRRQRQRAL

SEQ ID NO: 24104 - protein, 279 aa, Homo sapiens
  ENSP00000430243
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKEVLEMRNKIREQNRQDVKSAGPQSQLLASVIAEKSRSPSTESQLMSKGDEDTKDDSEETVPNPFSQLTDQELEEYKKEVERKKLELDETGQE

SEQ ID NO: 24105 - protein, 332 aa, Homo sapiens
  ENSP00000414546
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKSTESQLMSKGDEDTKDDSEETVPNPFSQLTDQELEEYKKEVERKKLELD

SEQ ID NO: 24106 - protein, 559 aa, Homo sapiens
  ENSP00000388072
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPSGSSVPGAGLQDP

SEQ ID NO: 24107 - protein, 575 aa, Homo sapiens
  ENSP00000398112
MPRRRVPGANCKPTGKMSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPVEQRLPLTGGETCLPSGSSVPGAGLQDP

SEQ ID NO: 24108 - protein, 226 aa, Homo sapiens
  ENSP00000412357
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCII

SEQ ID NO: 24109 - protein, 142 aa, Homo sapiens
  ENSP00000412681
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYR

SEQ ID NO: 24110 - protein, 17 aa, Homo sapiens
  ENSP00000403722
MSEETVPEAASPPPPQG

SEQ ID NO: 24111 - protein, 1279 aa, Homo sapiens
  ENSP00000475778
MRGHGNHSRLKSRCASLGNVHHHQAQMAHGAHCRGGRTPQSPDSRGPTAGGHTRGRWTYRPIEALINVSFPGAKGGRTAEGEPSWAWVFRSGYLQRQALPGLPVSTRVAACWWQHHPGRDSGFLGPGFIDLLREEPSGRADGKAAAQKTGRLYLFPTFLGNKLPEAADSFGEIASGNSVIFTSVLQSSHPPGTPPPSARKPSPGAAMLVCEETLELGAQGCWGSTSPRGQAVSLVGGPTAGGSRLGGAGCTMGLLMALQARRPRDGTWADPRRCSRAVEGSGLTRAALVSPGPSGVEEDTRREGCVLVGSWRSSTHRSRVLIINTPSGRTPWSQGSLGSTGRYNQTRAPGSQQQGLCSDAALHEDFVPEPTPAFFQYPPQAFSKTKVRDLGRGGLYAFSKEEKVSEAQRVEAYETHGLGLSTGRQNPVPSPCKPGCVCQGLALDAEAWPRHPGRRPCAAKEACLGPPGCSGELSLPEEEGIAPGAATAAPAWVPHGRVSRFLTVKLFTYVTMYQCKQERILRLCISGESGRYVRRSRFRNFAALMVSTGVPGVLQLGARPLRGGGHPYGDSQAGKVVEWRAGDRASGLSAGERRFLSQSELQTWPRTPHCVGKKVPQPVGAADLAPDTSLCRKEGSSASRSCRPGPGHLTRREEDSFRQLAFPRFEEVTFPPLTAAERAPSVHGGHSLASQGLVLAGRTRSVASGGKQELSGPLAACIPTQDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTACWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 24112 - protein, 560 aa, Homo sapiens
  ENSP00000376384
MDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 24113 - protein, 463 aa, Homo sapiens
  ENSP00000376383
MLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 24114 - protein, 34 aa, Homo sapiens
  ENSP00000424927
MLRFYLIGGGIPIIVCGITAAANIKNYGSRPNAP

SEQ ID NO: 24115 - protein, 1321 aa, Homo sapiens
  ENSP00000334952
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 24116 - protein, 381 aa, Homo sapiens
  ENSP00000422606
MPLKRNNSKYPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKGKFR

SEQ ID NO: 24117 - protein, 616 aa, Homo sapiens
  ENSP00000421006
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKVCYILQSFKTIYS

SEQ ID NO: 24118 - protein, 97 aa, Homo sapiens
  ENSP00000425223
MASYIDQDMQVLWYQDGRIVETDESQGIFVEKNMIHNCSLIASALTISNIQAGSTGNWGCHVQTKRGNNTRTVDIVVLESSAQYCPPERVVNNKGDF

SEQ ID NO: 24119 - protein, 49 aa, Homo sapiens
  ENSP00000456781
MTPQSLLQTTLFLLSLLFLVQGAHGRGHREDFRFCSQRNQTHRSSLHYK

SEQ ID NO: 24120 - protein, 81 aa, Homo sapiens
  ENSP00000454321
MTPQSLLQTTLFLLSLLFLVQGRCPRQGPQGRLSLLQPAEPDTQEQPPLQTHTRPAHLHRELRRGPHSPCPFPCSPPCFPI

SEQ ID NO: 24121 - protein, 70 aa, Homo sapiens
  ENSP00000456166
MTPQSLLQTTLFLLSLLFLVQGAHGRGHREDFRFCSQRNQTHRSSLHYKPTPDLRISIENSEEALTVHAP

SEQ ID NO: 24122 - protein, 90 aa, Homo sapiens
  ENSP00000455812
MTPQSLLQTTLFLLSLLFLVQASASSGAHGRGHREDFRFCSQRNQTHRSSLHYKPTPDLRISIENSEEALTVHAPFPAAHPASRSFPDPR

SEQ ID NO: 24123 - protein, 140 aa, Homo sapiens
  ENSP00000456469
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSV

SEQ ID NO: 24124 - protein, 97 aa, Homo sapiens
  ENSP00000455245
MTPQSLLQTTLFLLSLLFLVQGSGTRHTGAASTTNPHQTCASPSRTPKRPSQSMPLSLQPTLLPDPSLTPGASTTSASTGTDMLGDYIFSMASVTSC

SEQ ID NO: 24125 - protein, 687 aa, Homo sapiens
  ENSP00000457456
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 24126 - protein, 693 aa, Homo sapiens
  ENSP00000455215
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 24127 - protein, 103 aa, Homo sapiens
  ENSP00000456796
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHA

SEQ ID NO: 24128 - protein, 256 aa, Homo sapiens
  ENSP00000456238
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQE

SEQ ID NO: 24129 - protein, 693 aa, Homo sapiens; identical to SEQ ID NO: 24126
  ENSP00000456794

SEQ ID NO: 24130 - protein, 110 aa, Homo sapiens
  ENSP00000457979
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDF

SEQ ID NO: 24131 - protein, 125 aa, Homo sapiens
  ENSP00000454263
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLL

SEQ ID NO: 24132 - protein, 146 aa, Homo sapiens
  ENSP00000454607
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVT

SEQ ID NO: 24133 - protein, 162 aa, Homo sapiens
  ENSP00000458063
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFH

SEQ ID NO: 24134 - protein, 118 aa, Homo sapiens
  ENSP00000457307
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASS

SEQ ID NO: 24135 - protein, 119 aa, Homo sapiens
  ENSP00000454364
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSL

SEQ ID NO: 24136 - protein, 167 aa, Homo sapiens
  ENSP00000455600
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHT

SEQ ID NO: 24137 - protein, 42 aa, Homo sapiens
  ENSP00000456494
MTPQSLLQTTLFLLSLLFLVQGAHGRGHREDFRFCSQRNQTH

SEQ ID NO: 24138 - protein, 159 aa, Homo sapiens
  ENSP00000456002
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTF

SEQ ID NO: 24139 - protein, 687 aa, Homo sapiens; identical to SEQ ID NO: 24125
  ENSP00000455351

SEQ ID NO: 24140 - protein, 113 aa, Homo sapiens
  ENSP00000457073
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLS

SEQ ID NO: 24141 - protein, 56 aa, Homo sapiens
  ENSP00000457122
MTPQSLLQTTLFLLSLLFLVQGAHGRGHREDFRFCSQRNQTHRSSLHYKPTPDLRI

SEQ ID NO: 24142 - protein, 107 aa, Homo sapiens
  ENSP00000456787
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGK

SEQ ID NO: 24143 - protein, 116 aa, Homo sapiens
  ENSP00000456632
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKA

SEQ ID NO: 24144 - protein, 687 aa, Homo sapiens; identical to SEQ ID NO: 24125
  ENSP00000373465

SEQ ID NO: 24145 - protein, 97 aa, Homo sapiens
  ENSP00000454574
MTPQSLLQTTLFLLSLLFLVQASGTRHTGAASTTNPHQTCASPSRTPKRPSQSMPLSLQPTLLPDPSLTPGASTTSASTGTDMLGDYIFSMASVTSC

SEQ ID NO: 24146 - protein, 687 aa, Homo sapiens; identical to SEQ ID NO: 24125
  ENSP00000456620

SEQ ID NO: 24147 - protein, 198 aa, Homo sapiens
  ENSP00000454855
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHP

SEQ ID NO: 24148 - protein, 97 aa, Homo sapiens; identical to SEQ ID NO: 24145
  ENSP00000454879

SEQ ID NO: 24149 - protein, 78 aa, Homo sapiens
  ENSP00000455209
MTPQSLLQTTLFLLSLLFLVQGRCPRQGPQGRLSLLQPAEPDTQEQPPLQTHTRPAHLHRELRRGPHSPCPFPCSPPC

SEQ ID NO: 24150 - protein, 144 aa, Homo sapiens
  ENSP00000458014
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATS

SEQ ID NO: 24151 - protein, 90 aa, Homo sapiens
  ENSP00000456603
MTPQSLLQTTLFLLSLLFLVQAPATGSHLQPLPPQVPTAGATGKTFASAASGTRHTGAASTTNPHQTCASPSRTPKRPSQSMPLSLQPTL

SEQ ID NO: 24152 - protein, 114 aa, Homo sapiens
  ENSP00000457657
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRD

SEQ ID NO: 24153 - protein, 116 aa, Homo sapiens; identical to SEQ ID NO: 24143
  ENSP00000455074

SEQ ID NO: 24154 - protein, 98 aa, Homo sapiens
  ENSP00000455226
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLY

SEQ ID NO: 24155 - protein, 95 aa, Homo sapiens
  ENSP00000455553
MTPQSLLQTTLFLLSLLFLVQAHPASRSFPDPRGLYHFCLYWNRHAGRLHLLYGKRDFLLSDKASSLLCFQHQEESLAQGPPLLATSVTSWWSPQ

SEQ ID NO: 24156 - protein, 84 aa, Homo sapiens
  ENSP00000457143
MTPQSLLQTTLFLLSLLFLVQGAHGRGHREDFRFCSQRNQTHRSSLHYKPTPDLRISIENSEEALTVHAPFPAAHPASRSFPDP

SEQ ID NO: 24157 - protein, 77 aa, Homo sapiens
  ENSP00000456819
MTPQSLLQTTLFLLSLLFLVQGAHGRGHREDFRFCSQRNQTHRSSLHYKPTPDLRISIENSEEALTVHAPFPAAHPA

SEQ ID NO: 24158 - protein, 168 aa, Homo sapiens
  ENSP00000455176
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHS

SEQ ID NO: 24159 - protein, 6 aa, Homo sapiens
  ENSP00000454490
MTPQSL

SEQ ID NO: 24160 - protein, 54 aa, Homo sapiens
  ENSP00000455965
MTPQSLLQTTLFLLSLLFLVQGAHGRGHREDFRFCSQRNQTHRSSLHYKPTPDL

SEQ ID NO: 24161 - protein, 94 aa, Homo sapiens
  ENSP00000454933
MTPQSLLQTTLFLLSLLFLVQGAHGRGHREDFRFCSQRNQTHRSSLHYKPTPDLRISIENSEEALTVHAPFPAAHPASRSFPDPRGLYHFCLYW

SEQ ID NO: 24162 - protein, 97 aa, Homo sapiens; identical to SEQ ID NO: 24124
  ENSP00000454779

SEQ ID NO: 24163 - protein, 97 aa, Homo sapiens; identical to SEQ ID NO: 24145
  ENSP00000457612

SEQ ID NO: 24164 - protein, 118 aa, Homo sapiens
  ENSP00000457063
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLS

SEQ ID NO: 24165 - protein, 68 aa, Homo sapiens
  ENSP00000457994
MTPQSLLQTTLFLLSLLFLVQASSLLCFQHQEESLAQGPPLLATSVTSWWSPQNISLPSAASFTFSFH

SEQ ID NO: 24166 - protein, 118 aa, Homo sapiens; identical to SEQ ID NO: 24164
  ENSP00000456256

SEQ ID NO: 24167 - protein, 687 aa, Homo sapiens; identical to SEQ ID NO: 24125
  ENSP00000444911

SEQ ID NO: 24168 - protein, 125 aa, Homo sapiens
  ENSP00000456682
MTPQSLLQTTLFLLSLLFLVQAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMC

SEQ ID NO: 24169 - protein, 100 aa, Homo sapiens
  ENSP00000457223
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGR

SEQ ID NO: 24170 - protein, 84 aa, Homo sapiens; identical to SEQ ID NO: 24156
  ENSP00000458087

SEQ ID NO: 24171 - protein, 111 aa, Homo sapiens
  ENSP00000456147
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFL

SEQ ID NO: 24172 - protein, 94 aa, Homo sapiens; identical to SEQ ID NO: 24161
  ENSP00000454233

SEQ ID NO: 24173 - protein, 167 aa, Homo sapiens; identical to SEQ ID NO: 24136
  ENSP00000456362

SEQ ID NO: 24174 - protein, 154 aa, Homo sapiens
  ENSP00000456263
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSA

SEQ ID NO: 24175 - protein, 131 aa, Homo sapiens
  ENSP00000454289
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQ

SEQ ID NO: 24176 - protein, 118 aa, Homo sapiens
  ENSP00000456544
MTPQSLLQTTLFLLSLLFLVQAPATGSHLQPLPPQVPTAGATGKTFASAASGTRHTGAASTTNPHQTCASPSRTPKRPSQSMPLSLQPTLLPDPSLTPGASTTSASTGTDMLGDYIFS

SEQ ID NO: 24177 - protein, 199 aa, Homo sapiens
  ENSP00000457953
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRR

SEQ ID NO: 24178 - protein, 164 aa, Homo sapiens
  ENSP00000457806
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTF

SEQ ID NO: 24179 - protein, 131 aa, Homo sapiens; identical to SEQ ID NO: 24175
  ENSP00000456599

SEQ ID NO: 24180 - protein, 122 aa, Homo sapiens
  ENSP00000457635
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCF

SEQ ID NO: 24181 - protein, 153 aa, Homo sapiens
  ENSP00000457178
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPS

SEQ ID NO: 24182 - protein, 187 aa, Homo sapiens
  ENSP00000456731
  MOD_RES (1)..(1): Any amino acid
XSVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVFGTYVPGYLLKLSAMGWGFPIFLVTLVALVDVDNYGPIILAVHRTP

SEQ ID NO: 24183 - protein, 692 aa, Homo sapiens
  ENSP00000398034
MTPQSLLQTTLFLLSLLFLVQASASSGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 24184 - protein, 1240 aa, Homo sapiens
  ENSP00000423388
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 24185 - protein, 1469 aa, Homo sapiens
  ENSP00000422533
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 24186 - protein, 1308 aa, Homo sapiens
  ENSP00000423787
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 24187 - protein, 1299 aa, Homo sapiens
  ENSP00000425033
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 24188 - protein, 1231 aa, Homo sapiens
  ENSP00000424120
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREPYRETSMGVKLNIAYQIGASEQCQGYKCHGYSTTEW

SEQ ID NO: 24189 - protein, 1342 aa, Homo sapiens
  ENSP00000421476
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 24190 - protein, 1351 aa, Homo sapiens
  ENSP00000424030
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 24191 - protein, 1528 aa, Homo sapiens
  ENSP00000421372
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 24192 - protein, 1274 aa, Homo sapiens
  ENSP00000425201
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 24193 - protein, 1283 aa, Homo sapiens
  ENSP00000423434
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEPYRETSMGVKLNIAYQIGASEQCQGYKCHGYSTTEW

SEQ ID NO: 24194 - protein, 1512 aa, Homo sapiens
  ENSP00000421627
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 24195 - protein, 1580 aa, Homo sapiens
  ENSP00000420931
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 24196 - protein, 1571 aa, Homo sapiens
  ENSP00000425884
MWPSQLLIFMMLLAPIIHGGKHSERHPALAAPLRHAERSPGGALPPRHLLQQPAAERTAAHRGQGPRGATRGVRGPGAQGAQIAAQAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 24197 - protein, 1503 aa, Homo sapiens
  ENSP00000424258
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNRGAMANHLISNALLRPHGTNNPYNTLLGEPAVCNNPSVSMYNAQEGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 24198 - protein, 918 aa, Homo sapiens
  ENSP00000424402
  MOD_RES (1)..(1): Any amino acid
XYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 24199 - protein, 148 aa, Homo sapiens
  ENSP00000425936
MAKRSAAAAVPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQLPSIAVSEPKGRNESMPLTLIREKG

SEQ ID NO: 24200 - protein, 6306 aa, Homo sapiens
  ENSP00000384582
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 24201 - protein, 2038 aa, Homo sapiens
  ENSP00000492531
MINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRL

SEQ ID NO: 24202 - protein, 72 aa, Homo sapiens
  ENSP00000492054
  MOD_RES (1)..(1): Any amino acid
XEGSTISCVVERTRGALDYVHVFYTISQIETDGINYLVDDFANASGTITFLPWQRSELLIEVSLPIIIYNCN

SEQ ID NO: 24203 - protein, 99 aa, Homo sapiens
  ENSP00000491057
VPHITVEEEDGEIRLLVIRAQGLLGRVTAEFRTVSLTAFSPEDYQNVAGTLEFQPGERYKYIFINITDNSIPELEKSFKVELLNLEGGVCEFLVRAGDE

SEQ ID NO: 24204 - protein, 567 aa, Homo sapiens
  ENSP00000492527
  MOD_RES (1)..(1): Any amino acid
XITVEEEDGEIRLLVIRAQGLLGRVTAEFRTVSLTAFSPEDYQNVAGTLEFQPGERYKYIFINITDNSIPELEKSFKVELLNLEGGAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGYPSATN

SEQ ID NO: 24205 - protein, 65 aa, Homo sapiens
  ENSP00000492538
  MOD_RES (1)..(1): Any amino acid
XLPTIHKRASLGVASQILVTIAASDHAHGVFEFSPESLFVSGTEPEDGYSTVTLNFQILHVLGLR

SEQ ID NO: 24206 - protein, 2624 aa, Homo sapiens
  ENSP00000392618
QLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 24207 - protein, 390 aa, Homo sapiens
  ENSP00000492630
TFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVCGISSVS

SEQ ID NO: 24208 - protein, 938 aa, Homo sapiens
  ENSP00000491425
NSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKRNATEPIIKSFS

SEQ ID NO: 24209 - protein, 73 aa, Homo sapiens
  ENSP00000491299
GQNLIRSIQINITRLAGTFGDVAVGLRISSDHKEQPIVTENAERQLVVKDGATYKVDVVPIKNQVVGCQSLPW

SEQ ID NO: 24210 - protein, 80 aa, Homo sapiens
  ENSP00000492781
  MOD_RES (1)..(1): Any amino acid
XDEQLSAMMHLIEKITTEGKIQAFSVASRTLFYEILCSLINPKRKDTRGFSHFAEVTENFAFSLLTNVTCGSPGEKSPAC

SEQ ID NO: 24211 - protein, 334 aa, Homo sapiens
  ENSP00000491767
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 24212 - protein, 192 aa, Homo sapiens
  ENSP00000492216
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQVLVSVSVIMNLVKAARRGAP

SEQ ID NO: 24213 - protein, 123 aa, Homo sapiens
  ENSP00000492328
MAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDV

SEQ ID NO: 24214 - protein, 123 aa, Homo sapiens; identical to SEQ ID NO: 24213
  ENSP00000491401

SEQ ID NO: 24215 - protein, 185 aa, Homo sapiens
  ENSP00000278175
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 24216 - protein, 138 aa, Homo sapiens
  ENSP00000431438
MSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 24217 - protein, 117 aa, Homo sapiens
  ENSP00000436837
MGSQVAFLPPPPARSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 24218 - protein, 83 aa, Homo sapiens
  ENSP00000433062
MKLVSVALMYLGSLAFLGADTARLDVASEFRKKWNKWALSRGKRELRMSSSYPTGLADVKAGPAQTLIRPQDMKGASRSPEDR

SEQ ID NO: 24219 - protein, 185 aa, Homo sapiens; identical to SEQ ID NO: 24215
  ENSP00000436607

SEQ ID NO: 24220 - protein, 139 aa, Homo sapiens
  ENSP00000434354
MKLVSVALMYLGSLAFLGADTARLDVASEFRKKWNKWALSRGKRELRMSSSYPTGLADVKAGPAQTLIRPQDMKGASRSPEDSCLSSPSPRPQQSGCRPHPSQALPPEHEQLPGPPELWLPLRDVHGAEAGTPDLPVHR

SEQ ID NO: 24221 - protein, 185 aa, Homo sapiens; identical to SEQ ID NO: 24215
  ENSP00000435124

SEQ ID NO: 24222 - protein, 83 aa, Homo sapiens; identical to SEQ ID NO: 24218
  ENSP00000434749

SEQ ID NO: 24223 - protein, 326 aa, Homo sapiens
  ENSP00000308549
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 24224 - protein, 326 aa, Homo sapiens; identical to SEQ ID NO: 24223
  ENSP00000356205

SEQ ID NO: 24225 - protein, 125 aa, Homo sapiens
  ENSP00000356204
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRRISQCMASTKS

SEQ ID NO: 24226 - protein, 326 aa, Homo sapiens; identical to SEQ ID NO: 24223
  ENSP00000338435

SEQ ID NO: 24227 - protein, 125 aa, Homo sapiens; identical to SEQ ID NO: 24225
  ENSP00000491900

SEQ ID NO: 24228 - protein, 210 aa, Homo sapiens
  ENSP00000483953
MVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 24229 - protein, 332 aa, Homo sapiens
  ENSP00000304501
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 24230 - protein, 475 aa, Homo sapiens
  ENSP00000369960
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARTKSRSVTRLECSGMILAHCNLRLPGSRDSPASASQAAGTTGMCHQADATRPS

SEQ ID NO: 24231 - protein, 324 aa, Homo sapiens
  ENSP00000431073
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGTYILKYDVLFWRKGLSVCTRLRERKEIKN

SEQ ID NO: 24232 - protein, 429 aa, Homo sapiens
  ENSP00000369956
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARGHTPMT

SEQ ID NO: 24233 - protein, 324 aa, Homo sapiens; identical to SEQ ID NO: 24231
  ENSP00000430414

SEQ ID NO: 24234 - protein, 427 aa, Homo sapiens
  ENSP00000430793
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARSSGF

SEQ ID NO: 24235 - protein, 455 aa, Homo sapiens
  ENSP00000346557
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARRGMDCRYFTKNCREHIKHVNFMMPPWRKGSEC

SEQ ID NO: 24236 - protein, 466 aa, Homo sapiens
  ENSP00000276393
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 24237 - protein, 466 aa, Homo sapiens; identical to SEQ ID NO: 24236
  ENSP00000369947

SEQ ID NO: 24238 - protein, 342 aa, Homo sapiens
  ENSP00000369946
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIDEETEAQEGKNDSPSFKQPVHHAAVLGLEVMEKENLEGVSRKDTCGVW

SEQ ID NO: 24239 - protein, 35 aa, Homo sapiens
  ENSP00000493019
MNPDLDTGHNTSAPAHWGELKNANFTGPNQTSSNS

SEQ ID NO: 24240 - protein, 520 aa, Homo sapiens
  ENSP00000306662
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 24241 - protein, 572 aa, Homo sapiens
  ENSP00000368766
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 24242 - protein, 450 aa, Homo sapiens
  ENSP00000480573
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAEEEEEEEEEEEECEPQAVPVSPASACSPPLQQPQGSRVLATLRGQVLLGRGVGAIGGQWWRRRAQLTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 24243 - protein, 413 aa, Homo sapiens [sequence omitted]

SEQ ID NO: 24244 - protein, 916 aa, Homo sapiens
  ENSP00000307461
METSQETSLFLVKILEELDSKQNTVSYQDLCKSLCARFDLSQLAKLRSVLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQTQESLNPNNLEYWMEDIYTPGYDSLLKRKEAEFRRAKVCKIAALIAAAACTVILVIVVPICTMKS

SEQ ID NO: 24245 - protein, 854 aa, Homo sapiens
  ENSP00000454088
METSQETSLFLVKILEELDSKQNTVSYQDLCKSLCARFDLSQLAKLRSVLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQHVG

SEQ ID NO: 24246 - protein, 730 aa, Homo sapiens
  ENSP00000353402
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSLKGKKPPVASNGVTGKGKTLSSQPKKADPAAVVKRTGSNAAQYKYGKNRVEADAKRLQTKEEELLKRKEALRNRLAQLRKERKDLRAAIEVNAGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRGHVLRKAKEWELKNGT

SEQ ID NO: 24247 - protein, 814 aa, Homo sapiens
  ENSP00000371983
MEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWLKVIKEAYSGCSGPVDSECPPPPSSPVHKAELEKKLSSERPSSDGEGVVENGITTCNGKEQVKRKKSSKSEAKGTVSKVTGKKITKIISLGKKKPSTDEQTSSAEEDVPTCGYLNVLSNSRWRERWCRVKDNKLIFHKDRTDLKTHIVSIPLRGCEVIPGLDSKHPLTFRLLRNGQEVAVLEASSSEDMGRWIGILLAETGSSTDPEALHYDYIDVEMSASVIQTAKQTFCFMNRRVISANPYLGGTSNGYAHPSGTALHYDDVPCINGSWEPEDGFPASCSRGLGEEVLYDNAGLYDNLPPPHIFARYSPADRKASRLSADKLSSNHYKYPASAQSVTNTSSVGRASLGLNSQLKGKKPPVASNGVTGKGKTLSSQPKKADPAAVVKRTGSNAAQYKYGKNRVEADAKRLQTKEEELLKRKEALRNRLAQLRKERKDLRAAIEVNAGRKPQAILEEKLKQLEEECRQKEAERVSLELELTEVKESLKKALAGGVTLGLAIEPKSGTSSPQSPVFRHRTLENSPISSCDTSDTEGPVPVNSAAVLKKSQAAPGSSPCRGHVLRKAKEWELKNGT

SEQ ID NO: 24248 - protein, 92 aa, Homo sapiens
  ENSP00000483962
GITTCNGKEQVKRKKSSKSEAKGTVSKVTGKKITKIISLGKKKPSTDEQTSSAEEDVPTCGKTALPGDEQRAPKWVSFSPAVVSVPSSSKAR

SEQ ID NO: 24249 - protein, 730 aa, Homo sapiens; identical to SEQ ID NO: 24246
  ENSP00000351245

SEQ ID NO: 24250 - protein, 814 aa, Homo sapiens; identical to SEQ ID NO: 24247
  ENSP00000410689

SEQ ID NO: 24251 - protein, 768 aa, Homo sapiens
  ENSP00000296721
MDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHNGCSPSHSIVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGETANKPQNSVPEQPLPVNCVSELRKRSPSIVASNQGRVLQKAKEWEMKKT

SEQ ID NO: 24252 - protein, 725 aa, Homo sapiens
  ENSP00000424427
MDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHNGCSPSHSIVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVLVNQGWKERWCRLKCNTLYFHKDHMDLRTHVNAIALQGCEVAPGFGPRHPFAFRILRNRQEVAILEASCSEDMGRWLGLLLVEMGSRVTPEALHYDYVDVETLTSIVSAGRNSFLYARSCQNQWPEPRVYDDVPYEKMQDEEPERPTGAQVKRHASSCSEKSHRVDPQVKVKRHASSANQYKYGKNRAEEDARRYLVEKEKLEKEKETIRTELIALRQEKRELKEAIRSSPGAKLKALEEAVATLEAQCRAKEERRIDLELKLVAVKERLQQSLAGGPALGLSVSSKPKSGEWEMKKT

SEQ ID NO: 24253 - protein, 818 aa, Homo sapiens
  ENSP00000303042
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENVSPRPKAVTPASAPDCTPVNSATTLKNRPLSVVVTGKGTVLQKAKEWEKKGAS

SEQ ID NO: 24254 - protein, 814 aa, Homo sapiens
  ENSP00000358276
MERYKALEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQKPDIAEKYLSASEYGSSVDGHPEVPETKDVKKKCSAGLKLSNLMNLGRKKSTSLEPVERSLETSSYLNVLVNSQWKSRWCSVRDNHLHFYQDRNRSKVAQQPLSLVGCEVVPDPSPDHLYSFRILHKGEELAKLEAKSSEEMGHWLGLLLSESGSKTDPEEFTYDYVDADRVSCIVSAAKNSLLLMQRKFSEPNTYIDGLPSQDRQEELYDDVDLSELTAAVEPTEEATPVADDPNERESDRVYLDLTPVKSFLHGPSSAQAQASSPTLSCLDNATEALPADSGPGPTPDEPCIKCPENLGEQQLESLEPEDPSLRITTVKIQTEQQRISFPPSCPDAVVATPPGASPPVKDRLRVTSAEIKLGKNRTEAEVKRYTEEKERLEKKKEEIRGHLAQLRKEKRELKETLLKCTDKEVLASLEQKLKEIDEECRGEESRRVDLELSIMEVKDNLKKAEAGPVTLGTTVDTTHLENPKAVTPASAPDCTPVNSATTLKNRPLSVVVTGKGTVLQKAKEWEKKGAS

SEQ ID NO: 24255 - protein, 312 aa, Homo sapiens
  ENSP00000396781
MERYKAQGCCCLVVQRRIRQVSASLEQLLTELDDFLKILDQENLSSTALVKKSCLAELLRLYTKSSSSDEEYIYMNKVTINKQQNAESQGKAPEEQGLLPNGEPSQHSSAPQKSLPDLPPPKMIPERKQLAIPKTESPEGYYEEAEPYDTSLNEDGEAVSSSYESYDEEDGSKGKSAPYQWPSPEAGIELMRDARICAFLWRKKWLGQWAKQLCVIKDNRLLCYKSSKDHSPQLDVNLLGSSVIHKEKQVRKKEHKLKITPMNADVIVLGLQSKDQAEQWLRVIQEVSGLPSEGASEGNQYTPDAQRFNCQK

SEQ ID NO: 24256 - protein, 1311 aa, Homo sapiens
  ENSP00000359489
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 24257 - protein, 1276 aa, Homo sapiens
  ENSP00000345459
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 24258 - protein, 427 aa, Homo sapiens
  ENSP00000359487
MDLFDFFRDWDLEQQCHYEQDRSALKKREWERRNQEVQQEDDLFSSGFDLFGEPYKTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKMLEDDLKLSSDEDDLEPVKTLTTQCTATELYQAVEKAKPRNNPVK

SEQ ID NO: 24259 - protein, 1276 aa, Homo sapiens
  ENSP00000359486
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILRESQHLTPGFTLQKWNDPTTRASTKMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 24260 - protein, 952 aa, Homo sapiens
  ENSP00000286437
MKFKRRHQAFPSFFKMKVSLPSDPSCVEEILRESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 24261 - protein, 609 aa, Homo sapiens
  ENSP00000379138
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 24262 - protein, 622 aa, Homo sapiens
  ENSP00000226359
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGKRRQNESFIRCELFSLILTDLTLFVN

SEQ ID NO: 24263 - protein, 405 aa, Homo sapiens
  ENSP00000387174
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGLPFFVLALTASTYLRPAGARARQSSPWPGPRGGQTSPHCAEGPQSAQLSGAMMN

SEQ ID NO: 24264 - protein, 804 aa, Homo sapiens
  ENSP00000338378
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 24265 - protein, 857 aa, Homo sapiens
  ENSP00000307634
MNYQQQLANSAAIRAEIQRFESVHPNIYSIYELLERVEEPVLQNQIREHVIAIEDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 24266 - protein, 108 aa, Homo sapiens
  ENSP00000489496
QLANSAAIRAEIQRFESVHPNIYSIYELLERVEEPVLQNQIREHVIAIEDAFVNSQEWTLSRSVPELKVGIVGNLASGKSALVHRYLTGTYVQEEYGCRWQVQERDCR

SEQ ID NO: 24267 - protein, 117 aa, Homo sapiens
  ENSP00000385492
MDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSE

SEQ ID NO: 24268 - protein, 1069 aa, Homo sapiens
  ENSP00000386897
MYLLDGSGEPASPPADAMPRGTPPRKTVYRISVTMVRKEQLAAPGSGGPDPRPVRRPRPARSPDAPGRLEEEAEEAEGAEEPEGPRPRAWDFRTFRTRSTGQLELGRLRPCARGLEPADLAGSAPAEEEGRGSPASGSPDVEGARAAPLRRSLSFRHWSGPEAPQGRTLGGGRRHSSSGSLAWAPCDEAAAGTTLEPATATQPASEKRNTLDVGEVLSKNDALSDLERWERSKSKNRTLDNSDLQRLERARAAAGAGAASEHRLLRFFSGIFARRDGGPGGGPSPRSGASRPRGYFSLRRAPAEAHSSSAESIDGSPRRDAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 24269 - protein, 253 aa, Homo sapiens
  ENSP00000403482
  MOD_RES (1)..(1): Any amino acid
XKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEAKRKAWKLNRVGSLRNIYSSSTNTEEQEENFEFIIVSLTGQTWHFEATTYEERDAWVQAIESQILASLQSC

SEQ ID NO: 24270 - protein, 276 aa, Homo sapiens
  ENSP00000393838
  MOD_RES (1)..(1): Any amino acid
XSSPKTNGLSKDMSSLHISPNSDTGLGDSVCSSPSISSTTSPKLDPPPSPHANRKKHRRKKSTSNFKADGLSGTAEAKRKAWKLNRVGSLRNIYSSSTNTEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLA

SEQ ID NO: 24271 - protein, 351 aa, Homo sapiens
  ENSP00000483085
DAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGLPFFVLALTASTYLRPAGARARQSSPWPGPRGGQTSPHCAEGPQSAQLSGAMMN

SEQ ID NO: 24272 - protein, 803 aa, Homo sapiens
  ENSP00000411824
DAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSGNVTSASGSQMASGISLVSFNSRPDGMHQRSYSVSSADQWSEATVIANSAISSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 24273 - protein, 750 aa, Homo sapiens
  ENSP00000484463
DAFVNSQEWTLSRSVPELKVGIVGNLASGKSALVHRYLTGTYVQEESPEGGRFKKEIVVDGQSYLLLIRDEGGPPEAQFAMWVDAVIFVFSLEDEISFQTVYHYYSRMANYRNTSEIPLVLVGTQDAISSANPRVIDDARARKLSNDLKRCTYYETCATYGLNVERVFQDVAQKIVATRKKQQLSIGPCKSLPNSPSHSSVCSAQVSAVHISQTSNGGGSLSDYSSSVPSTPSTSQKELRIDVPPTANTPTPVRKQSKRRSNLFTSRKGSDPDKEKKGLESRADSIGSGRAIPIKQGMLLKRSGKSLNKEWKKKYVTLCDNGVLTYHPSLHDYMQNVHGKEIDLLRTTVKVPGKRPPRATSACAPISSPKTNGLSKDMSSLHISPNSDTGLGDSVCSSPSISSTTSPKLDPPPSPHANRKKHRRKKSTSNFKADGLSGTAEEQEENFEFIIVSLTGQTWHFEATTYEERDAWVQAIESQILASLQSCESSKNKSRLTSQSEAMALQSIRNMRGNSHCVDCETQNPNWASLNLGALMCIECSGIHRNLGTHLSRVRSLDLDDWPVELIKVMSSIGNELANSVWEESSQGRTKPSVDSTREEKERWIRAKYEQKLFLAPLPCTELSLGQHLLRATADEDLRTAILLLAHGSRDEVNETCGEGDGRTALHLACRKGNVVLAQLLIWYGVDVTARDAHGNTALAYARQASSQECIDVLLQYGCPDERFVLMATPNLSRRNNNRNNSSGRVPTII

SEQ ID NO: 24274 - protein, 126 aa, Homo sapiens
  ENSP00000431912
  MOD_RES (1)..(1): Any amino acid
XQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKSSLFTVVILRSKNAKKEQDELLCGGWES

SEQ ID NO: 24275 - protein, 902 aa, Homo sapiens
  ENSP00000435582
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 24276 - protein, 824 aa, Homo sapiens
  ENSP00000436630
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNEVVFLFLTLCHTDSLTSRISTSLPQCDKCNSHLRYPNLTVPLGARKH

SEQ ID NO: 24277 - protein, 331 aa, Homo sapiens
  ENSP00000436063
MFPALETHLKQTIPDPYEDFMYRHLQYYGYFKAQRGSLPNSATHQHVRKNNPQCLLNGSLGEKDDLIPDTLQKEKLLYSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQ

SEQ ID NO: 24278 - protein, 148 aa, Homo sapiens
  ENSP00000432264
MYRHLQYYGYFKAQRGSLPNSATHQHVRKNNPQCLLNGSLGEKDDLIPDTLQKEKLLWPISLSSAVHRQIEAINRDSHMLSLPHLRSRQLLYDELDEVNPRLREPQELFSILSTKRPLQAPRWPIECEVIKENIHHIEWAPPQPEYFY

SEQ ID NO: 24279 - protein, 61 aa, Homo sapiens
  ENSP00000432090
MFPALETHLKQTIPDPYEDFMYRHLQYYGYFKGSRSVTQAGGQWPPHPRLKQPSQPLAIIF

SEQ ID NO: 24280 - protein, 95 aa, Homo sapiens
  ENSP00000436518
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINR

SEQ ID NO: 24281 - protein, 32 aa, Homo sapiens
  ENSP00000431835
MFPALETHLKQTIPDPYEDFMYRHLQYYGYFK

SEQ ID NO: 24282 - protein, 904 aa, Homo sapiens
  ENSP00000350228
MFPALETHLKQTIPDPYEDFMYRHLQYYGYFKAQRGSLPNSATHQHVRKNNPQCLLNGSLGEKDDLIPDTLQKEKLLWPISLSSAVHRQIEAINRDFHSCLGWMQWRGLSSLQPPPPRFKDSPASAFRVAGITDSHMLSLPHLRSRQLLYDELDEVNPRLREPQELFSILSTKRPLQAPRWPIECEVIKENIHHIEWAPPQPEYFYQPKGNEKVPEIVGEKKGTVVYQLDSVPIEGSYFTSSRVGGKRGIVKELAVTLQGPEDNTLLFESRFESGNLQKAVRVDTYEYELTLRTDLYTNKHTQWFYFRVQNTRKDATYRFTIVNLLKPKSLYTVGMKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQMKFTQCLAELKELLRQEIHKKFHELGQDVDLEGSWSDISLSDIESRNSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 24283 - protein, 376 aa, Homo sapiens
  ENSP00000291572
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 24284 - protein, 79 aa, Homo sapiens
  ENSP00000389318
MGLLAFLKTQFVLHLLVGFVFVVSGLVINFVQLCTLALWPVSKQLYRRLNCRLAYSLWSQLVMLLEWWSCTECTLFTDQ

SEQ ID NO: 24285 - protein, 376 aa, Homo sapiens; identical to SEQ ID NO: 24283
  ENSP00000381138

SEQ ID NO: 24286 - protein, 376 aa, Homo sapiens; identical to SEQ ID NO: 24283
  ENSP00000332989

SEQ ID NO: 24287 - protein, 128 aa, Homo sapiens
  ENSP00000412079
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLY

SEQ ID NO: 24288 - protein, 376 aa, Homo sapiens; identical to SEQ ID NO: 24283
  ENSP00000381140

SEQ ID NO: 24289 - protein, 376 aa, Homo sapiens; identical to SEQ ID NO: 24283
  ENSP00000381135

SEQ ID NO: 24290 - protein, 255 aa, Homo sapiens
  ENSP00000413906
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCV

SEQ ID NO: 24291 - protein, 38 aa, Homo sapiens
  ENSP00000394102
MGLLAFLKTQFVLHLLVGFVFVVSGLVINFVQLCTLAL

SEQ ID NO: 24292 - protein, 255 aa, Homo sapiens; identical to SEQ ID NO: 24290
  ENSP00000414440

SEQ ID NO: 24293 - protein, 376 aa, Homo sapiens; identical to SEQ ID NO: 24283
  ENSP00000443510

SEQ ID NO: 24294 - protein, 378 aa, Homo sapiens
  ENSP00000314036
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 24295 - protein, 105 aa, Homo sapiens
  ENSP00000400211
  MOD_RES (1)..(1): Any amino acid
XSAVYDCTLNFRNNENPTLLGVLNGKKYHADLYVRRIPLEDIPEDDDECSAWLHKLYQEKGWGDTEFSKQYVSVSRPGRLALCPSEKIAEQQVEVVHGFSKQSGE

SEQ ID NO: 24296 - protein, 133 aa, Homo sapiens
  ENSP00000413901
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGFDLLHVACMPLELGLFS

SEQ ID NO: 24297 - protein, 159 aa, Homo sapiens
  ENSP00000355872
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGVSQKCIPPCLTHFSGSAPPLVFLLLVIQNLQKNQQSFYLMKWS

SEQ ID NO: 24298 - protein, 118 aa, Homo sapiens
  ENSP00000355878
MDLAGLLKSQFLCHLVFCYVFIASGLIINTIQLFTLLLWPINKQLFRKINCRLSYCISSRLQGPGQERAGLCPNYRLDVVLHRDGLLFAQVGAGSQDGCHQFAAPPGLPREVFFPDSL

SEQ ID NO: 24299 - protein, 2045 aa, Homo sapiens
  ENSP00000368678
MAGRSHPGPLRPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 24300 - protein, 85 aa, Homo sapiens
  ENSP00000492725
MPPLPLARDTRQPPGASLLVRGFMVPCNACLILLATATLGFAVLLFLNNYKPGTHFTPVPPTPPDACRGMLCGFGAVCEPNAEGP

SEQ ID NO: 24301 - protein, 287 aa, Homo sapiens
  ENSP00000400771
  MOD_RES (1)..(1): Any amino acid
XKGDFVSLALRDRRLEFRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNT

SEQ ID NO: 24302 - protein, 1930 aa, Homo sapiens
  ENSP00000484607
MRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 24303 - protein, 485 aa, Homo sapiens
  ENSP00000355627
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 24304 - protein, 131 aa, Homo sapiens
  ENSP00000433789
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLDCRSGQEENHPLLRLFL

SEQ ID NO: 24305 - protein, 149 aa, Homo sapiens
  ENSP00000257247
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 24306 - protein, 121 aa, Homo sapiens
  ENSP00000433635
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSA

SEQ ID NO: 24307 - protein, 5890 aa, Homo sapiens
  ENSP00000367263
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLGETQSRTITVTRRVTAYTVDVTGREGAKDIDISSPEFKIKIPRHELTEISNVDVETQSGKTVIRLPSGSGAASPTGSAVDIRAGAISASGPELQGAGHSKLQVTMPGIKVGGSGVNVNAKGLDLGGRGGVQVPAVDISSSLGGRAVEVQGPSLESGDHGKIKFPTMKVPKFGVSTGREGQTPKAGLRVSAPEVSVGHKGGKPGLTIQAPQLEVSVPSANIEGLEGKLKGPQITGPSLEGDLGLKGAKPQGHIGVDASAPQIGGSITGPSVEVQAPDIDVQGPGSKLNVPKMKVPKFSVSGAKGEETGIDVTLPTGEVTVPGVSGDVSLPEIATGGLEGKMKGTKVKTPEMIIQKPKISMQDVDLSLGSPKLKGDIKVSAPGVQGDVKGPQVALKGSRVDIETPNLEGTLTGPRLGSPSGKTGTCRISMSEVDLNVAAPKVKGGVDVTLPRVEGKVKVPEVDVRGPKVDVSAPDVEAHGPEWNLKMPKMKMPTFSTPGAKGEGPDVHMTLPKGDISISGPKVNVEAPDVNLEGLGGKLKGPDVKLPDMSVKTPKISMPDVDLHVKGTKVKGEYDVTVPKLEGELKGPKVDIDAPDVDVHGPDWHLKMPKMKMPKFSVPGFKAEGPEVDVNLPKADVDISGPKIDVTAPDVSIEEPEGKLKGPKFKMPEMNIKVPKISMPDVDLHLKGPNVKGEYDVTMPKVESEIKVPDVELKSAKMDIDVPDVEVQGPDWHLKMPKMKMPKFSMPGFKAEGPEVDVNLPKADVDISGPKVGVEVPDVNIEGPEGKLKGPKFKMPEMNIKAPKISMPDVDLHMKGPKVKGEYDMTVPKLEGDLKGPKVDVSAPDVEMQGPDWNLKMPKIKMPKFSMPSLKGEGPEFDVNLSKANVDISAPKVDTNAPDLSLEGPEGKLKGPKFKMPEMHFRAPKMSLPDVDLDLKGPKMKGNVDISAPKIEGEMQVPDVDIRGPKVDIKAPDVEGQGLDWSLKIPKMKMPKFSMPSLKGEGPEVDVNLPKADVVVSGPKVDIEAPDVSLEGPEGKLKGPKFKMPEMHFKTPKISMPDVDLHLKGPKVKGDVDVSVPKVEGEMKVPDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDVDIKGPKVDISAPDVDVHGPDWHLKMPKVKMPKFSMPGFKGEGPEVDVKLPKADVDVSGPKMDAEVPDVNIEGPDAKLKGPKFKMPEMSIKPQKISIPDVGLHLKGPKMKGDYDVTVPKVEGEIKAPDVDIKGPKVDINAPDVEVHGPDWHLKMPKVKMPKFSMPGFKGEGPEVDMNLPKADLGVSGPKVDIDVPDVNLEAPEGKLKGPKFKMPSMNIQTHKISMPDVGLNLKAPKLKTDVDVSLPKVEGDLKGPEIDVKAPKMDVNVGDIDIEGPEGKLKGPKFKMPEMHFKAPKISMPDVDLHLKGPKVKGDMDVSVPKVEGEMKVPDVDIKGPKVDIDAPDVEVHDPDWHLKMPKMKMPKFSMPGFKAEGPEVDVNLPKADIDVSGPSVDTDAPDLDIEGPEGKLKGSKFKMPKLNIKAPKVSMPDVDLNLKGPKLKGEIDASVPELEGDLRGPQVDVKGPFVEAEVPDVDLECPDAKLKGPKFKMPEMHFKAPKISMPDVDLHLKGPKVKGDADVSVPKLEGDLTGPSVGVEVPDVELECPDAKLKGPKFKMPDMHFKAPKISMPDVDLHLKGPKVKGDVDVSVPKLEGDLTGPSVGVEVPDVELECPDAKLKGPKFKMPEMHFKTPKISMPDVDLHLKGPKVKGDMDVSVPKVEGEMKVPDVDIKGPKMDIDAPDVDVHGPDWHLKMPKMKMPKFSMPGFKAEGPEVDVNLPKADVVVSGPKVDVEVPDVSLEGPEGKLKGPKLKMPEMHFKAPKISMPDVDLHLKGPKVKGDVDVSLPKLEGDLTGPSVDVEVPDVELECPDAKLKGPKFKMPEMHFKTPKISMPDVNLNLKGPKVKGDMDVSVPKVEGEMKVPDVDIRGPKVDIDAPDVDVHGPDWHLKMPKMKMPKFSMPGFKGEGPEVDVNLPKADVDVSGPKVDVEVPDVSLEGPEGKLKGPKFKMPEMHFKTPKISMPDVDFNLKGPKIKGDVDVSAPKLEGELKGPELDVKGPKLDADMPEVAVEGPNGKWKTPKFKMPDMHFKAPKISMPDLDLHLKSPKAKGEVDVDVPKLEGDLKGPHVDVSGPDIDIEGPEGKLKGPKFKMPDMHFKAPNISMPDVDLNLKGPKIKGDVDVSVPEVEGKLEVPDMNIRGPKVDVNAPDVQAPDWHLKMPKMKMPKFSMPGFKAEGPEVDVNLPKADVDISGPKVDIEGPDVNIEGPEGKLKGPKLKMPEMNIKAPKISMPDFDLHLKGPKVKGDVDVSLPKVEGDLKGPEVDIKGPKVDINAPDVGVQGPDWHLKMPKVKMPKFSMPGFKGEGPDGDVKLPKADIDVSGPKVDIEGPDVNIEGPEGKLKGPKFKMPEMNIKAPKISMPDIDLNLKGPKVKGDVDVSLPKVEGDLKGPEVDIKGPKVDIDAPDVDVHGPDWHLKMPKIKMPKISMPGFKGEGPDVDVNLPKADIDVSGPKVDVECPDVNIEGPEGKWKSPKFKMPEMHFKTPKISMPDIDLNLTGPKIKGDVDVTGPKVEGDLKGPEVDLKGPKVDIDVPDVNVQGPDWHLKMPKMKMPKFSMPGFKAEGPEVDVNLPKADVDVSGPKVDVEGPDVNIEGPEGKLKGPKFKMPEMNIKAPKIPMPDFDLHLKGPKVKGDVDISLPKVEGDLKGPEVDIRGPQVDIDVPDVGVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMKVPDVDIKGPKVDINAPDVDVQGPDWHLKMPKIKMPKISMPGFKGEGPEVDVNLPKADLDVSGPKVDVDVPDVNIEGPDAKLKGPKFKMPEMNIKAPKISMPDLDLNLKGPKMKGEVDVSLANVEGDLKGPALDIKGPKIDVDAPDIDIHGPDAKLKGPKLKMPDMHVNMPKISMPEIDLNLKGSKLKGDVDVSGPKLEGDIKAPSLDIKGPEVDVSGPKLNIEGKSKKSRFKLPKFNFSGSKVQTPEVDVKGKKPDIDITGPKVDINAPDVEVQGKVKGSKFKMPFLSISSPKVSMPDVELNLKSPKVKGDLDIAGPNLEGDFKGPKVDIKAPEVNLNAPDVDVHGPDWNLKMPKMKMPKFSVSGLKAEGPDVAVDLPKGDINIEGPSMNIEGPDLNVEGPEGGLKGPKFKMPDMNIKAPKISMPDIDLNLKGPKVKGDVDISLPKLEGDLKGPEVDIKGPKVDINAPDVDVHGPDWHLKMPKVKMPKFSMPGFKGEGPEVDVTLPKADIDISGPNVDVDVPDVNIEGPDAKLKGPKFKMPEMNIKAPKISMPDFDLNLKGPKMKGDVVVSLPKVEGDLKGPEVDIKGPKVDIDTPDINIEGSEGKFKGPKFKIPEMHLKAPKISMPDIDLNLKGPKVKGDVDVSLPKMEGDLKGPEVDIKGPKVDINAPDVDVQGPDWHLKMPKVKMPKFSMPGFKGEGPDVDVNLPKADLDVSGPKVDIDVPDVNIEGPEGKLKGPKFKMPEMNIKAPKISMPDIDLNLKGPKVKGDMDVSLPKVEGDMQVPDLDIKGPKVDINAPDVDVRGPDWHLKMPKIKMPKISMPGFKGEGPEVDVNLPKADLDVSGPKVDVDVPDVNIEGPDAKLKGPKFKMPEMNIKAPKISMPDFDLHLKGPKVKGDVDVSLPKMEGDLKAPEVDIKGPKVDIDAPDVDVHGPDWHLKMPKVKMPKFSMPGFKGEGPEVDVNLPKADIDVSGPKVDIDTPDIDIHGPEGKLKGPKFKMPDLHLKAPKISMPEVDLNLKGPKMKGDVDVSLPKVEGDLKGPEVDIKGPKVDIDVPDVDVQGPDWHLKMPKVKMPKFSMPGFKGEGPDVDVNLPKADLDVSGPKVDIDVPDVNIEGPDAKLKGPKFKMPEMNIKAPKISMPDFDLHLKGPKVKGDVDVSLPKVEGDLKGPEVDIKGPKVDIDAPDVDVHGPDWHLKMPKVKMPKFSMPGFKGEGPDVDVTLPKADIEISGPKVDIDAPDVSIEGPDAKLKGPKFKMPEMNIKAPKISMPDIDFNLKGPKVKGDVDVSLPKVEGDLKGPEIDIKGPSLDIDTPDVNIEGPEGKLKGPKFKMPEMNIKAPKISMPDFDLHLKGPKVKGDVDVSLPKVESDLKGPEVDIEGPEGKLKGPKFKMPDVHFKSPQISMSDIDLNLKGPKIKGDMDISVPKLEGDLKGPKVDVKGPKVGIDTPDIDIHGPEGKLKGPKFKMPDLHLKAPKISMPEVDLNLKGPKVKGDMDISLPKVEGDLKGPEVDIRDPKVDIDVPDVDVQGPDWHLKMPKVKMPKFSMPGFKGEGPDVDVNLPKADIDVSGPKVDVDVPDVNIEGPDAKLKGPKFKMPEMSIKAPKISMPDIDLNLKGPKVKGDVDVTLPKVEGDLKGPEADIKGPKVDINTPDVDVHGPDWHLKMPKVKMPKFSMPGFKGEGPDVDVSLPKADIDVSGPKVDVDIPDVNIEGPDAKLKGPKFKMPEINIKAPKISIPDVDLDLKGPKVKGDFDVSVPKVEGTLKGPEVDLKGPRLDFEGPDAKLSGPSLKMPSLEISAPKVTAPDVDLHLKAPKIGFSGPKLEGGEVDLKGPKVEAPSLDVHMDSPDINIEGPDVKIPKFKKPKFGFGAKSPKADIKSPSLDVTVPEAELNLETPEISVGGKGKKSKFKMPKIHMSGPKIKAKKQGFDLNVPGGEIDASLKAPDVDVNIAGPDAALKVDVKSPKTKKTMFGKMYFPDVEFDIKSPKFKAEAPLPSPKLEGELQAPDLELSLPAIHVEGLDIKAKAPKVKMPDVDISVPKIEGDLKGPKVQANLGAPDINIEGLDAKVKTPSFGISAPQVSIPDVNVNLKGPKIKGDVPSVGLEGPDVDLQGPEAKIKFPKFSMPKIGIPGVKMEGGGAEVHAQLPSLEGDLRGPDVKLEGPDVSLKGPGVDLPSVNLSMPKVSGPDLDLNLKGPSLKGDLDASVPSMKVHAPGLNLSGVGGKMQVGGDGVKVPGIDATTKLNVGAPDVTLRGPSLQGDLAVSGDIKCPKVSVGAPDLSLEASEGSIKLPKMKLPQFGISTPGSDLHVNAKGPQVSGELKGPGVDVNLKGPRISAPNVDFNLEGPKVKGSLGATGEIKGPTVGGGLPGIGVQGLEGNLQMPGIKSSGCDVNLPGVNVKLPTGQISGPEIKGGLKGSEVGFHGAAPDISVKGPAFNMASPESDFGINLKGPKIKGGADVSGGVSAPDISLGEGHLSVKGSGGEWKGPQVSSALNLDTSKFAGGLHFSGPKVEGGVKGGQIGLQAPGLSVSGPQGHLESGSGKVTFPKMKIPKFTFSGRELVGREMGVDVHFPKAEASIQAGAGDGEWEESEVKLKKSKIKMPKFNFSKPKGKGGVTGSPEASISGSKGDLKSSKASLGSLEGEAEAEASSPKGKFSLFKSKKPRHRSNSFSDEREFSGPSTPTGTLEFEGGEVSLEGGKVKGKHGKLKFGTFGGLGSKSKGHYEVTGSDDETGKLQGSGVSLASKKSRLSSSSSNDSGNKVGIQLPEVELSVSTKKE

SEQ ID NO: 24308 - protein, 144 aa, Homo sapiens
  ENSP00000433286
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQRIYTTKIKPRLKSEDGVEGDLG

SEQ ID NO: 24309 - protein, 123 aa, Homo sapiens
  ENSP00000435357
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLSGDDEEYQR

SEQ ID NO: 24310 - protein, 85 aa, Homo sapiens
  ENSP00000436845
MEKEETTRELLLPNWQGSGSHGLTIAQRDDGVFVQEVTQNSPAARTGVVKEGDQIVGATIYFDNLQSGEVTQLLNTMGHHTVGLK

SEQ ID NO: 24311 - protein, 701 aa, Homo sapiens
  ENSP00000424601
MPRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 24312 - protein, 719 aa, Homo sapiens
  ENSP00000323816
MPRTMIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYDYIHVDDRQDFCRQLHWAMDPPQVVFGQPPPLETGDDAILGRLLRAQEWGTGTPTEYSAFLTRCFICRVRCLLDSTSGFLARGSQAWQLRLCCPEPLMTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 24313 - protein, 547 aa, Homo sapiens [sequence omitted]

SEQ ID NO: 24314 - protein, 12 aa, Homo sapiens
  ENSP00000430914
MHQNIYDYIHVD

SEQ ID NO: 24315 - protein, 157 aa, Homo sapiens
  ENSP00000428893
MIPPGECTYAGRKRRRPLQKQRPAVGAEKSNPSKRHRDRLNAELDHLASLLPFPPDIISKLDKLSVLRLSVSYLRVKSFFQVVQEQSSRQPAAGAPSPGDSCPLAGSAVLEGRLLLESLNGFALVVSAEGTIFYASATIVDYLGFHQTDVMHQNIYD

SEQ ID NO: 24316 - protein, 139 aa, Homo sapiens
  ENSP00000430842
MIPPGECTYAGRKRRRPLQKQRPAVGAEKSNPSKRHRDRLNAELDHLASLLPFPPDIISKLDKLSVLRLSVSYLRVKSFFQGQGLAVADAEDVDDHTGERRPMSFRRPRALDTQALRRTQFGLHLLMVNIAGLIATDRL

SEQ ID NO: 24317 - protein, 81 aa, Homo sapiens
  ENSP00000429944
MIPPGECTYAGRKRRRPLQKQRPAVGAEKSNPSKRHRDRLNAELDHLASLLPFPPDIISKLDKLSVLRLSVSYLRVKSFFQ

SEQ ID NO: 24318 - protein, 557 aa, Homo sapiens
  ENSP00000426932
MRGRGMPTDVMHQNIYDYIHVDDRQDFCRQLHWAMDPPQVVFGQPPPLETGDDAILGRLLRAQEWGTGTPTEYSAFLTRCFICRVRCLLDSTSGFLTMQFQGKLKFLFGQKKKAPSGAMLPPRLSLFCIAAPVLLPSAAEMKMRSALLRAKPRADTAATADAKVKATTSLCESELHGKPNYSAGRSSRESGVLVLREQTDAGRWAQVPARAPCLCLRGGPDLVLDPKGGSGDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLGASDRSHPATFPTRMHLKTEPDSRQQVYISHLGHGVRGAQPHGRATAGRSRELTPFHPAHCACLEPTDGLPQSEPPHQLCARGRGEQSCTCRAAEAAPVVKREPLDSPQWATHSQGMVPGMLPKSALATLVPPQASGCTFLP

SEQ ID NO: 24319 - protein, 215 aa, Homo sapiens
  ENSP00000426076
LLPSAAEMKMRSALLRAKPRADTAATADAKDREEEQHRMLSRASGVTGRRETPGPTKPLPWTAGKHSEDGARPRLQPSKNDPPSLRPMPRGSCLPCPCVQGTFRNSPISHPPSPSPSAYSSRTSRPMRDVGEDQVHPPLCHFPQRSLQHQLPQPGAQRFATRGYPMEDMKLQGVPMPPGDLCGPTLLLDVSIKMEKDSGCEGAADGCVPSQVWLG

SEQ ID NO: 24320 - protein, 203 aa, Homo sapiens
  ENSP00000451569
MKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 24321 - protein, 338 aa, Homo sapiens
  ENSP00000216479
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGHFATITLTFIDKNGETELCMEGRGIPAPEEERTRQGWQRYYFEGIKQTFGYGARLF

SEQ ID NO: 24322 - protein, 288 aa, Homo sapiens
  ENSP00000440108
MAKWGEGDPRWIVEERADATNVNNWHWTERDASNWSTDKLKTLFLAVQVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVPEKHIVMKWRFKSWPEGSHCHSG

SEQ ID NO: 24323 - protein, 100 aa, Homo sapiens
  ENSP00000451467
MAKWGEGDPRWIVEERADATNVNNWHWTERDASNWSTDKLKTLFLAVQVQNEEGKCEVTEVSKLDGEASINNRKGKLIFFYEWSVKLNWTGKSKLGCQRD

SEQ ID NO: 24324 - protein, 216 aa, Homo sapiens
  ENSP00000451475
  MOD_RES (1)..(1): Any amino acid
XCEVTEVSKLDGEASINNRKGKLIFFYEWSVKLNWTGTSKSGVQYKGHVEIPNLSDENSVDEVEISVSLAKDEPDTNLVALMKEEGVKLLREAMGIYISTLKTEFTQGMILPTMNGESVDPVGQPALKTEERKAKPAPSKTQARPVGVKIPTCKITLKETFLTSPEELYRVFTTQELVQAFTHAPATLEADRGGKFHMVDGNVSGEFTDLVSTCRP

SEQ ID NO: 24325 - protein, 133 aa, Homo sapiens
  ENSP00000452127
  MOD_RES (1)..(1): Any amino acid
XWSVKLNWTGTSKSGVQYKGHVEIPNLSDENSVDEVEISVSLAKDEPDTNLVALMKEEGVKLLREAMGIYISTLKTGHFATITLTFIDKNGETELCMEGRGIPAPEEERTRQGWQRYYFEGIKQTFGYGARLF

SEQ ID NO: 24326 - protein, 90 aa, Homo sapiens
  ENSP00000450890
  MOD_RES (1)..(1): Any amino acid
XVGVKIPTCKITLKETFLTSPEELYRVFTTQELVQAFTHAPATLEADRGGKFHMVDGNVSGEFTDLVPEKHIVMKWRFKSWPEGSHCHSG

SEQ ID NO: 24327 - protein, 714 aa, Homo sapiens
  ENSP00000297625
MLQNPQEKSQAYPRRRRPGCYAYRQNPEAIAAAAMYTFLPDNFSPAKPKPSKDLKPLLGSAVLGLLLVLAAVVAWCYYSVSLRKAERLRAELLDLKAGGFSIRNQKGEQVFRLAFRSGALDLDSCSRDGALLGCSLTADGLPLHFFIQTVRPKDTVMCYRVRWEEAAPGRAVEHAMFLGDAAAHWYGGAEMRTQHWPIRLDGQQEPQPFVTSDVYSSDAAFGGILERYWLSSRAAAIKVNDSVPFHLGWNSTERSLRLQARYHDTPYKPPAGRAAAPELSYRVCVGSDVTSIHKYMVRRYFNKPSRVPAPEAFRDPIWSTWALYGRAVDQDKVLRFAQQIRLHHFNSSHLEIDDMYTPAYGDFDFDEVKFPNASDMFRRLRDAGFRVTLWVHPFVNYNSSRFGEGVERELFVREPTGRLPALVRWWNGIGAVLDFTHPKARDWFQGHLRRLRSRYSVASFKFDAGEVSYLPRDFSTYRPLPDPSVWSRRYTEMALPFFSLAEVRVGYQSQNISCFFRLVDRDSVWGYDLGLRSLIPAVLTVSMLGYPFILPDMVGGNAVPQRTAGGDVPERELYIRWLEVAAFMPAMQFSIPPWRYDAEVVAIAQKFAALRASLVAPLLLELAGEVTDTGDPIVRPLWWIAPGDETAHRIDSQFLIGDTLLVAPVLEPGKQERDVYLPAGKWRSYKGELFDKTPVLLTDYPVDLDEIAYFTWAS

SEQ ID NO: 24328 - protein, 160 aa, Homo sapiens
  ENSP00000368437
FLPDNFSPAKPKPSKDLKPLLGSAVLGLLLVLAAVVAWCYYSVSLRKAERLRAELLDLKAGGFSIRNQKGEQEPQPFVTSDVYSSDAAFGGILERYWLSSRAAAIKVNDSVPFHLGWNSTERSLRLQARYHDTPYKPPAGRAAAPELSYRVCVGSDVTSI

SEQ ID NO: 24329 - protein, 171 aa, Homo sapiens
  ENSP00000448458
MAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 24330 - protein, 223 aa, Homo sapiens
  ENSP00000322175
MASKLLRAVILGPPGSGKGTVCQRIAQNFGLQHLSSGHFLRENIKASTEVGEMAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 24331 - protein, 223 aa, Homo sapiens; identical to SEQ ID NO: 24330
  ENSP00000445912

SEQ ID NO: 24332 - protein, 223 aa, Homo sapiens; identical to SEQ ID NO: 24330
  ENSP00000378743

SEQ ID NO: 24333 - protein, 76 aa, Homo sapiens
  ENSP00000462259
MSVQYPRRRATAGEKPGNEPEEVKLQNASKQIVQNAILQAVQQVSQESQRREERISDNRDHIQLGVGELTKKHEKK

SEQ ID NO: 24334 - protein, 69 aa, Homo sapiens
  ENSP00000399075
MVFAPGEKPGNEPEEVKLQNASKQIVQNAILQAVQQVSQESQRREERISDNRDHIQLGVGELTKKHEKK

SEQ ID NO: 24335 - protein, 1745 aa, Homo sapiens
  ENSP00000453768
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSK

SEQ ID NO: 24336 - protein, 179 aa, Homo sapiens
  ENSP00000453634
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHGENLYDLQTHFKFVIFLLFF

SEQ ID NO: 24337 - protein, 2813 aa, Homo sapiens
  ENSP00000378026
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 24338 - protein, 2817 aa, Homo sapiens
  ENSP00000354718
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 24339 - protein, 38 aa, Homo sapiens
  ENSP00000453620
MKLNPQQAPLYGDCVVTVLLAEEDKAEDDVVFYLVFLG

SEQ ID NO: 24340 - protein, 93 aa, Homo sapiens
  ENSP00000452622
MNIQQQLMKTNLKQMDSLMPLMMTAQDPSSAPETDGQFLPCAPEPTDPQRLSSSEETESTQCCPGSPVAQTESPCDLSSIVEEENTDRSCRKK

SEQ ID NO: 24341 - protein, 146 aa, Homo sapiens
  ENSP00000452698
MGLRYSGCLGSHVENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPC

SEQ ID NO: 24342 - protein, 98 aa, Homo sapiens
  ENSP00000483091
MPDVKAEDEVDFRASSISEEVAVGSIAATLKMKQGPMTQAINRENWCTIEPCPDAASLLASKQSPECENFLDVGLGRECTSKQGVLKRESGSDSDLFH

SEQ ID NO: 24343 - protein, 967 aa, Homo sapiens
  ENSP00000481485
MYERHKRRYSLCDISKVDRTVDVVLLKINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSE

SEQ ID NO: 24344 - protein, 1429 aa, Homo sapiens
  ENSP00000477780
MLYINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 24345 - protein, 275 aa, Homo sapiens
  ENSP00000453205
PSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGL

SEQ ID NO: 24346 - protein, 66 aa, Homo sapiens
  ENSP00000482058
MSSSKKSKEKEKEKDKIKEKEKDSKDKEKDKKTVNGHTFSSIPVVGPISCSQCMKPFTNKDAYTCA

SEQ ID NO: 24347 - protein, 166 aa, Homo sapiens
  ENSP00000480789
MSIKWARFHEVPHITVRFIGPKHGEEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKS

SEQ ID NO: 24348 - protein, 1434 aa, Homo sapiens
  ENSP00000378018
MYERHKRRYSLCDISKVDRTVDVVLLKINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 24349 - protein, 1439 aa, Homo sapiens
  ENSP00000363201
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 24350 - protein, 899 aa, Homo sapiens
  ENSP00000223791
MPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 24351 - protein, 1358 aa, Homo sapiens
  ENSP00000363188
MLRSEWPVFPEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLEEATEKMVSMKPPGFQASLARDGHMSGLGKAEAAPPGPGVPPHPPGTKSAASHQSSMTSLEGSGISERLPQKPLHRGGGPHLEETWMASPETDSGFVGSETSRVSPLTQTPEHRLSHISTAGTLAQPFAASVPRDGASYPKARGSLIPRRATEPSTPRSQAQRYLSSPSGPLRQRAPNFSLERTLAAEMAVPGSEFEGHKRISEQPLPNKTISPPPAPAPAAAPLPCGPTETIPSFLLTRAGRDQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 24352 - protein, 831 aa, Homo sapiens
  ENSP00000309222
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVARATPMEFQDSSAPPAQSPQHATDRWRRETTRFFCPQPKEHIWKQTKTSPKPLPSRFIGSISPLNPQPRPTRQGRPLPRQGATLAGRSSSNAPKYGRGQLNYPLPDFSKVGPRVRFPKDESYRPPKSRSHNRKPQAPARPLIFKSPAEIVQEVLLSSGEAALAKDTPPAHPITRVPQEFQTPEQATELVHQLQEDYHRLLTKYAEAENTIDQLRLGAKVNLFSDPPQPNHSIHTGMVPQGTKVLSFTIPQPRSAEWWPGPAEDPQASAASGWPSARGDLSPSSLTSMPTLGWLPENRDISEDQSSAEQTQALASQASQFLAKVESFERLIQAGRLMPQDQVKGFQRLKAAHAALEEEYLKACREQHPAQPLAGSKGTPGRFDPRRELEAEIYRLGSCLEELKEHIDQTQQEPEPPGSDSALDSTPALPCLHQPTHLPAPSGQAPMPAIKTSCPEPATTTAAASTGPCPLHVNVEVSSGNSEVEDRPQDPLARLRHKELQMEQVYHGLMERYLSVKSLPEAMRMEEEEEGEEEEEEEGGGDSLEVDGVAATPGKAEATRVLPRQCPVQAEKSHGAPLE

SEQ ID NO: 24353 - protein, 1439 aa, Homo sapiens; identical to SEQ ID NO: 24349
  ENSP00000303769

SEQ ID NO: 24354 - protein, 384 aa, Homo sapiens
  ENSP00000363192
MSAGGGTRGYSPRSPGATSQAICELQEEVSRLRLRLEDSLHQPLQGSPTRPASAFDRPARTRGRPADSPATWGSHYGSKSTERLPGEPRGEEQIVPPGRQRARSSSVPREVLRLSLSSESELPSLPLFSEKSKTTKDSPQAARDGKRGVGSAGWPDRVTFRGQYTGHEYHVLSPKAVPKGNGTVSCPHCRPIRTQDAGGAVTGDPLGPPPADTLQCPLCGQVGSPPEADGPGSATSGAEKATTRRKASSTPSPKQRSKQAGSSPRPPPGLWYLATAPPAPAPPAFAYISSVPIMPYPPAAVYYAPAGPTSAQPAAKWPPTASPPPARRHRHSIQLDLGDLEELNKALSRAVQAAESVRSTTRQMRSSLSADLRQAHSLRGSCLF

SEQ ID NO: 24355 - protein, 323 aa, Homo sapiens
  ENSP00000370254
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 24356 - protein, 248 aa, Homo sapiens
  ENSP00000416415
  MOD_RES (1)..(1): Any amino acid
XSKYQCVKLNDGHFMPVLGFGTYAPAEVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNV

SEQ ID NO: 24357 - protein, 205 aa, Homo sapiens
  ENSP00000370240
MGVVSLFLCIVEQIFTSSKKIQFRGIFMAKVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQPRDNSIFSLSPDW

SEQ ID NO: 24358 - protein, 323 aa, Homo sapiens
  ENSP00000370129
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 24359 - protein, 297 aa, Homo sapiens
  ENSP00000392694
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 24360 - protein, 200 aa, Homo sapiens
  ENSP00000474566
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQR

SEQ ID NO: 24361 - protein, 139 aa, Homo sapiens
  ENSP00000408440
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKEDIGILTWKKSPKHNS

SEQ ID NO: 24362 - protein, 155 aa, Homo sapiens
  ENSP00000474188
MQISQVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILN

SEQ ID NO: 24363 - protein, 323 aa, Homo sapiens
  ENSP00000401327
MDSKHQCLKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 24364 - protein, 300 aa, Homo sapiens
  ENSP00000474882
MQISQVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 24365 - protein, 323 aa, Homo sapiens
  ENSP00000369927
MDSKHQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 24366 - protein, 323 aa, Homo sapiens
  ENSP00000369814
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKQTPALIALRYQLQRGVVVLAKSYNEQRIRENIQVFEFQLTSEDMKVLDGLNRNYRYVVMDFLMDHPDYPFSDEY

SEQ ID NO: 24367 - protein, 323 aa, Homo sapiens; identical to SEQ ID NO: 24366
  ENSP00000263126

SEQ ID NO: 24368 - protein, 574 aa, Homo sapiens
  ENSP00000379501
MRGGEVALGWNKKKRLFCEDFRFKMVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 24369 - protein, 587 aa, Homo sapiens
  ENSP00000332369
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 24370 - protein, 550 aa, Homo sapiens
  ENSP00000337131
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 24371 - protein, 221 aa, Homo sapiens
  ENSP00000407204
  MOD_RES (1)..(1): Any amino acid
XLSFVRPQCRATDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTL

SEQ ID NO: 24372 - protein, 583 aa, Homo sapiens
  ENSP00000305988
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 24373 - protein, 570 aa, Homo sapiens
  ENSP00000419236
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSANENREKVNDQAKLIVGIVVGLLLAALVAGVVYWLYMKKSKTASKHVNKDLGNMEENKKLEENNHKTEA

SEQ ID NO: 24374 - protein, 532 aa, Homo sapiens
  ENSP00000418213
MFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 24375 - protein, 344 aa, Homo sapiens
  ENSP00000418937
  MOD_RES (1)..(1): Any amino acid
XLGDCISEDSYPDGNITWYRNGKVLHPLEGAVVIIFKKEMDPVTQLYTMTSTLEYKTTKADIQMPFTCSVTYYGPSGQKTIHSEQAVFDIYYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 24376 - protein, 501 aa, Homo sapiens
  ENSP00000297785
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 24377 - protein, 230 aa, Homo sapiens
  ENSP00000366138
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGASVV

SEQ ID NO: 24378 - protein, 238 aa, Homo sapiens
  ENSP00000388026
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMD

SEQ ID NO: 24379 - protein, 203 aa, Homo sapiens
  ENSP00000401361
MSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTAL

SEQ ID NO: 24380 - protein, 501 aa, Homo sapiens; identical to SEQ ID NO: 24376
  ENSP00000297785

SEQ ID NO: 24381 - protein, 230 aa, Homo sapiens; identical to SEQ ID NO: 24377
  ENSP00000366138

SEQ ID NO: 24382 - protein, 238 aa, Homo sapiens; identical to SEQ ID NO: 24378
  ENSP00000388026

SEQ ID NO: 24383 - protein, 203 aa, Homo sapiens; identical to SEQ ID NO: 24379
  ENSP00000401361

SEQ ID NO: 24384 - protein, 144 aa, Homo sapiens
  ENSP00000452789
MSECEIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIG

SEQ ID NO: 24385 - protein, 512 aa, Homo sapiens
  ENSP00000332256
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIGVCGAITPWNFPLLMLVWKLAPALCCGNTMVLKPAEQTPLTALYLGSLIKEAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 24386 - protein, 141 aa, Homo sapiens
  ENSP00000454107
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAMTTSCASPGMSPLVSVGPSLHGTSPC

SEQ ID NO: 24387 - protein, 102 aa, Homo sapiens
  ENSP00000453328
MATANGAVENGQPDRKPPALPRPIRNLEVKFTKVRRAPLPPDGRGPLRWAARLGAAGAREQRAGGPPGAAETRASLPGRGSPETAPFAGRLGRDRRRRGSAL

SEQ ID NO: 24388 - protein, 405 aa, Homo sapiens
  ENSP00000343294
MATANGAVENGQPDRKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 24389 - protein, 912 aa, Homo sapiens
  ENSP00000273450
MAGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 24390 - protein, 902 aa, Homo sapiens
  ENSP00000420293
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 24391 - protein, 801 aa, Homo sapiens
  ENSP00000395881
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 24392 - protein, 902 aa, Homo sapiens; identical to SEQ ID NO: 24390
  ENSP00000377083

SEQ ID NO: 24393 - protein, 47 aa, Homo sapiens
  ENSP00000419448
MKIAVIGQSLFGQEVYCHLRKEGHEVVGVFTVPDKDGKADPLDTRTE

SEQ ID NO: 24394 - protein, 81 aa, Homo sapiens
  ENSP00000418905
MKIAVIGQSLFGQEVYCHLRKEGHEVVGVFTVPDKDGKADPLGPSFTEIRKGGFPSSGRMMVWTPETCCCRRSVRCSRTTP

SEQ ID NO: 24395 - protein, 177 aa, Homo sapiens
  ENSP00000418711
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMV

SEQ ID NO: 24396 - protein, 168 aa, Homo sapiens
  ENSP00000419826
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFL

SEQ ID NO: 24397 - protein, 157 aa, Homo sapiens
  ENSP00000419955
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPD

SEQ ID NO: 24398 - protein, 100 aa, Homo sapiens
  ENSP00000426594
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRH

SEQ ID NO: 24399 - protein, 47 aa, Homo sapiens; identical to SEQ ID NO: 24393
  ENSP00000426713

SEQ ID NO: 24400 - protein, 505 aa, Homo sapiens
  ENSP00000377081
MKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRAPPSPSTRPDPTAT

SEQ ID NO: 24401 - protein, 505 aa, Homo sapiens; identical to SEQ ID NO: 24400
  ENSP00000414126

SEQ ID NO: 24402 - protein, 923 aa, Homo sapiens
  ENSP00000258494
MLRRGSQALRRFSTGRVYFKNKLKLALIGQSLFGQEVYSHLRKEGHRVVGVFTVPDKDGKADPLALAAEKDGTPVFKLPKWRVKGKTIKEVAEAYRSVGAELNVLPFCTQFIPMDIIDSPKHGSIIYHPSILPRHRGASAINWTLIMGDKKAGFSVFWADDGLDTGPILLQRSCDVEPNDTVDALYNRFLFPEGIKAMVEAVQLIADGKAPRIPQPEEGATYEGIQKKENAEISWDQSAEVLHNWIRGHDKVPGAWTEINGQMVTFYGSTLLNSSVPPGEPLEIKGAKKPGLVTKNGLVLFGNDGKALTVRNLQFEDGKMIPASQYFSTGETSVVELTAEEVKVAETIKVIWAGILSNVPIIEDSTDFFKSGASSMDVARLVEEIRQKCGGLQLQNEDVYMATKFEGFIQKVVRKLRGEDQEVELVVDYISKEVNEIMVKMPYQCFINGQFTDADDGKTYDTINPTDGSTICKVSYASLADVDKAVAAAKDAFENGEWGRMNARERGRLMYRLADLLEENQEELATIEALDSGAVYTLALKTHIGMSVQTFRYFAGWCDKIQGSTIPINQARPNRNLTFTKKEPLGVCAIIIPWNYPLMMLAWKSAACLAAGNTLVLKPAQVTPLTALKFAELSVKAGFPKGVINIIPGSGGIAGQRLSEHPDIRKLGFTGSTPIGKQIMKSCAVSNLKKVSLELGGKSPLIIFNDCELDKAVRMGMGAVFFNKGENCIAAGRLFVEESIHDEFVTRVVEEIKKMKIGDPLDRSTDHGPQNHKAHLEKLLQYCETGVKEGATLVYGGRQVQRPGFFMEPTVFTDVEDYMYLAKEESFGPIMVISKFQNGDIDGVLQRANSTEYGLASGVFTRDINKAMYVSEKLEAGTVFINTYNKTDVAAPFGGVKQSGFGKDLGEEALNEYLKTKTVTLEY

SEQ ID NO: 24403 - protein, 203 aa, Homo sapiens
  ENSP00000447538
MLRRGSQALRRFSTGRVYFKNKLKLALIGQSLFGQEVYSHLRKEGHRVVGVFTVPDKDGKADPLALAAEKDGTPVFKLPKWRVKGKTIKEVAEAYRSVGAELNVLPFCTQFIPMDIIDSPKHGSIIYHPSILPRHRGASAINWTLIMGDKKAGFSVFWADDGLDTGPILLQRSCDVEPNDTVDALYNRFLFPEGIKAMKLSNS

SEQ ID NO: 24404 - protein, 92 aa, Homo sapiens
  ENSP00000447464
  MOD_RES (1)..(1): Any amino acid
XVEEIKKMKIGDPLDRSTDHGPQNHKAHLEKLLQYCETGVKEGATLVYGGRQVQRPGFFMEPTVFTDVEDYMYLAKEESFGPIMVISKFQNG

SEQ ID NO: 24405 - protein, 535 aa, Homo sapiens
  ENSP00000450436
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 24406 - protein, 522 aa, Homo sapiens
  ENSP00000342564
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 24407 - protein, 252 aa, Homo sapiens
  ENSP00000452081
MGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 24408 - protein, 336 aa, Homo sapiens
  ENSP00000378729
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 24409 - protein, 364 aa, Homo sapiens
  ENSP00000378731
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHAY

SEQ ID NO: 24410 - protein, 364 aa, Homo sapiens; identical to SEQ ID NO: 24409
  ENSP00000226253

SEQ ID NO: 24411 - protein, 180 aa, Homo sapiens
  ENSP00000463174
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQ

SEQ ID NO: 24412 - protein, 175 aa, Homo sapiens
  ENSP00000462674
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYA

SEQ ID NO: 24413 - protein, 135 aa, Homo sapiens
  ENSP00000465623
MAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARY

SEQ ID NO: 24414 - protein, 149 aa, Homo sapiens
  ENSP00000398976
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWR

SEQ ID NO: 24415 - protein, 122 aa, Homo sapiens
  ENSP00000463118
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGE

SEQ ID NO: 24416 - protein, 552 aa, Homo sapiens
  ENSP00000493203
MQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 24417 - protein, 1620 aa, Homo sapiens
  ENSP00000373700
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 24418 - protein, 129 aa, Homo sapiens
  ENSP00000414027
  MOD_RES (1)..(1): Any amino acid
XNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIGNPNLITVGPLHRGGN

SEQ ID NO: 24419 - protein, 152 aa, Homo sapiens
  ENSP00000387488
SSISDLKEVPRKNITLIRGLGHGAFGEVYEGQVSGMPNDPSPLQVAVKTLPEVCSEQDELDFLMEALIISLSWKQLFCFTFCLRPSWEKSTMNSSTQSTHQYLRKTLSCPLRHFLTQVPEQHPHSSSHSPANGTPVEPAVVLPTCSPARFWV

SEQ ID NO: 24420 - protein, 1243 aa, Homo sapiens
  ENSP00000482733
MPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 24421 - protein, 674 aa, Homo sapiens
  ENSP00000484468
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQYDWCSWIPNAPPTMRAPPPTAKGVVTIEQIVDTLPDRGRSCWHLGAVWALSQFQENELFLGMYPEEHFIEKPVKEAMARFRKNLEAIVSVIAERNKKKQLPYYYLSPDRIPNSVAI

SEQ ID NO: 24422 - protein, 617 aa, Homo sapiens
  ENSP00000479958
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEKLPVTTEMVECSLERQLSLEQEVQQGNIFIVDFELLDGIDANKTDPCTLQFLAAPICLLYKNLANKIVPIAIQLNQIPGDENPIFLPSDAKYDWLLAKIWVRSSDFHVHQTITHLLRTHLVSEVFGIAMYRQLPAVHPIFKLLVAHVRFTIAINTKAREQLICECGLFDKANATGGGGHVQMVQRAMKDLTYASLCFPEAIKARGMESKEDIPYYFYRDDGLLVWEAIRTFTAEVVDIYYEGDQVVEEDPELQDFVNDVYVYGMRGRKSSGFPKSVKSREQLSEYLTVVIFTASAQHAAVNFGQLFLGMYPEEHFIEKPVKEAMARFRKNLEAIVSVIAERNKKKQLPYYYLSPDRIPNSVAI

SEQ ID NO: 24423 - protein, 139 aa, Homo sapiens
  ENSP00000479452
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGREMDGVEPWLPLEHRCQMPQGFTP

SEQ ID NO: 24424 - protein, 674 aa, Homo sapiens; identical to SEQ ID NO: 24421
  ENSP00000363512

SEQ ID NO: 24425 - protein, 617 aa, Homo sapiens; identical to SEQ ID NO: 24422
  ENSP00000437634

SEQ ID NO: 24426 - protein, 139 aa, Homo sapiens; identical to SEQ ID NO: 24423
  ENSP00000483803

SEQ ID NO: 24427 - protein, 1657 aa, Homo sapiens
  ENSP00000264276
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQPLLEEAIPNLHSPPTTSTSALNSLVVSCASAVGVRVAATYEAGALSLKKVMNFYSTTPCETGAQAGSSAIGPEGLKDSREEQVKQESMQGKKSSSLVDIREEETEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGYHSLALTAKSQVYSWGSNTFGQLGHSDFPTTVPRLAKISSENGVWSIAAGRDYSLFLVDTEDFQPGLYYSGRQDPTEGDNLPENHSGSKTPVLLSCSKLGYISRVTAGKDSYLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPNGDYIEGYFSGEWGSGIKITGTYFKPSLYESDKDRPKVFRKLGNLAVPADEKWKAVFDECWRQLGCEGPGQGEVWKAWDNIAVALTTSRRQHRDSPEILSRSQTQTLESLEFIPQHVGAFSVEKYDDIRKYLIKACDTPLHPLGRLVETLVAVYRMTYVGVGANRRLLQEAVKEIKSYLKRIFQLVRFLFPELPEEGSTIPLSAPLPTERKSFCTGKSDSRSESPEPGYVVTSSGLLLPVLLPRLYPPLFMLYALDNDREEDIYWECVLRLNKQPDIALLGFLGVQRKFWPATLSILGESKKVLPTTKDACFASAVECLQQISTTFTPSDKLKVIQQTFEEISQSVLASLHEDFLWSMDDLFPVFLYVVLRARIRNLGSEVHLIEDLMDPYLQHGEQGIMFTTLKACYYQIQREKLN

SEQ ID NO: 24428 - protein, 585 aa, Homo sapiens
  ENSP00000403832
  MOD_RES (1)..(1): Any amino acid
XLALVDKNIMGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKDNSGLIEQVGKCSLLPYFLKVCEALVLFLL

SEQ ID NO: 24429 - protein, 396 aa, Homo sapiens
  ENSP00000429223
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSIADSEASPLLAVRILQLACGEEHTLALSISREIWAWGTGCQLGLITTAFPVTKPQKVEHLAGRVVLQVACGAFHSLALVQCLPSQDLKPVPERCNQCSQLLITMTDKEDHVIISDSHCCPLGVTLTESQAENHASTALSPSTETLDRQEEVFENTLVANDQSVATELNAVSAQITSSDAMSSQQNVMGTTEISSARNIPSYPDTQAVNEYLRKLSDHSVREDSEHGEKPVPSQVPAQFYKIKVCLELNCMGFSLETLK

SEQ ID NO: 24430 - protein, 139 aa, Homo sapiens
  ENSP00000386384
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAVTDNGVAYMWGENSAGQCAVANQQYVPEPNPVSI

SEQ ID NO: 24431 - protein, 106 aa, Homo sapiens
  ENSP00000386948
MDSKKRSSTEAEGSKERGLVHIWQAGSFPITPERLPGWGGKTVLQAALGVKHGVLLTEDGEVYSFGTLPWRSGPVEICPSSPILENALVGQYVITVATGSFHSGAV

SEQ ID NO: 24432 - protein, 445 aa, Homo sapiens
  ENSP00000286190
MYPNPLIYCTCWDPWNLGPRKLIKTPQLPRKNSTGSSKLTPLVPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVPWRRDQINRHWHDVLQQLLLMQVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 24433 - protein, 124 aa, Homo sapiens
  ENSP00000402327
  MOD_RES (1)..(1): Any amino acid
XSIYDEMEEKWSKQKAKWKKDEKFERENILLQQKKKMTKKFEMESGEEDKKINESCSAVFENFIQEKEELLKQHQSDTLQLEELRKTKEVMQEELHAQALILESLNTNLYYTQLELQKEAKDNF

SEQ ID NO: 24434 - protein, 422 aa, Homo sapiens
  ENSP00000376086
MYPNPLIYCTCWDPWNLGPRKLIKTPQLPRKNSTGSSKLTPLVPAPKNHNYLQPTKPVVSPKMKIHSARQEETNKSFYEVINVSPGYQLVRNREQISVTLGDEMFDRKKRWESEIPDKGRFSRTNIISDLEEQISELTAIIEQMNRDHQSAQKLLSSEMDLRCAEMKQNFENKNRELKEAHEAELSELENNYKAALKAEKLAAQEKLEEMGKEYKYLKNMFRTYQDSIYDEMEEKWSKQKAKWKKDEKFERENILLQQKKKMTKKFEMESGEEDKKINESCSAVFENFIQEKEELLKQHQSDTLQLEELRKTKEVMQEELHAQALILESLNTNLYYTQLELQKEKAIVGNLEKMLQTKFAETEEKYKHTIQILTEENIHLKQKIISKNEEICEGCSGRLASITVSKDDSDTVQDGSKKGQES

SEQ ID NO: 24435 - protein, 422 aa, Homo sapiens; identical to SEQ ID NO: 24434
  ENSP00000412073

SEQ ID NO: 24436 - protein, 143 aa, Homo sapiens
  ENSP00000393945
MKIHSARQEETNKSFYEVINVSPGYQLVRNREQISVTLGDEMFDRKKRWESEIPDKGRFSRELKEAHEAELSELENNYKAALKAEKLAAQEKLEEMGKEYKYLKNMFRTYQDSIYDEMEEKWSKQKAKWKKDEKFERENILLQ

SEQ ID NO: 24437 - protein, 49 aa, Homo sapiens
  ENSP00000407585
MYPNPLIYCTCWDPWNLGPRKLIKTPQLPRKNSTGSSKLTPLVPAPKNH

SEQ ID NO: 24438 - protein, 445 aa, Homo sapiens; identical to SEQ ID NO: 24432
  ENSP00000385098

SEQ ID NO: 24439 - protein, 111 aa, Homo sapiens
  ENSP00000432707
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTP

SEQ ID NO: 24440 - protein, 776 aa, Homo sapiens
  ENSP00000379802
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 24441 - protein, 267 aa, Homo sapiens
  ENSP00000433284
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITD

SEQ ID NO: 24442 - protein, 212 aa, Homo sapiens
  ENSP00000433937
MALSSEPAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPGGHPLCV

SEQ ID NO: 24443 - protein, 767 aa, Homo sapiens
  ENSP00000379801
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 24444 - protein, 677 aa, Homo sapiens
  ENSP00000435382
MPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKLKCGS

SEQ ID NO: 24445 - protein, 774 aa, Homo sapiens
  ENSP00000436987
MEPGSAEMPRQFPKLNISEVDEQVRLLAEKVFAKVLREEDSKDALSLFTVPEDCPIGQKEAKERELQKELAEQKSVETAKRKKSFKMIRSQSLSLQMPPQQDWKGPPAASPAMSPTTPVVTGATSLPTPAPYAMPEFQRVTISGDYCAGITLEDYEQAAKSLAKALMIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 24446 - protein, 767 aa, Homo sapiens; identical to SEQ ID NO: 24443
  ENSP00000431648

SEQ ID NO: 24447 - protein, 110 aa, Homo sapiens
  ENSP00000433351
AAACMNQKHLLRFIKHTYQTEPDRTVAEKRGRKITLRQVFDGLHMDPYDLTVDSLDVHAVSELLLQCRQQTAALAGDSAPWKATMIVLAGRCYGSSFLFYLTERSCGLRE

SEQ ID NO: 24448 - protein, 90 aa, Homo sapiens
  ENSP00000434608
PPYSYYLYYMYANIMVLNNLRRERGLSTFLFRPHCGEAGSITHLVSAFLTADNISHGLLLKKQQQFVPRIFQEPSEGIPTQGTACFSFHR

SEQ ID NO: 24449 - protein, 608 aa, Homo sapiens
  ENSP00000396000
MIREKYARLAYHRFPRITSQYLGHPRADTAPPEEGLPDFHPPPLPQEDPYCLDDAPPNLDYLVHMQGGILFVYDNKKMLEHQEPHSLPYPDLETYTVDMSHILALITDGPTKTYCHRRLNFLESKFSLHEMLNEMSEFKELKSNPHRDFYNVRKVDTHIHAAACMNQKHLLRFIKHTYQTEPDRTVAEKRGRKITLRQVFDGLHMDPYDLTVDSLDVHAGRQTFHRFDKFNSKYNPVGASELRDLYLKTENYLGGEYFARMVKEVARELEESKYQYSEPRLSIYGRSPEEWPNLAYWFIQHKVYSPNMRWIIQVPRIYDIFRSKKLLPNFGKMLENIFLPLFKATINPQDHRELHLFLKYVTGFDSVDDESKHSDHMFSDKSPNPDVWTSEQNPPYSYYLYYMYANIMVLNNLRRERGLSTFLFRPHCGEAGSITHLVSAFLTADNISHGLLLKKSPVLQYLYYLAQIPIAMSPLSNNSLFLEYSKNPLREFLHKGLHVSLSTDDPMQFHYTKEALMEEYAIAAQVWKLSTCDLCEIARNSVLQSGLSHQEKQKFLGQNYYKEGPEGNDIRKTNVAQIRMAFRYETLCNELSFLSDAMKSEEITALTN

SEQ ID NO: 24450 - protein, 498 aa, Homo sapiens
  ENSP00000308149
MLQCRPAQEFSFGPRALKDALVSTDAALQQLYVSAFSPAERLFLAEAYNPQRTLFCTLLIRTGFDWLLSRPEAPEDFQTFHASLQHRKPRLARKHIYLQPIDLSEEPVGSSLLHQLCSCTEAFFLGLRVKCLPSVAAASIRCSSRPSRDSDRLQLHTDGILSFLKNNKPGDALCVLGLTLSDLYPHEAWSFTFSKFLPGHEVGVCSFARFSGEFPKSGPSAPDLALVEAAADGPEAPLQDRGWALCFSALGMVQCCKVTCHELCHLLGLGNCRWLRCLMQGALSLDEALRRPLDLCPICLRKLQHVLGFRLIERYQRLYTWTQAVVGTWPSQEAGEPSVWEDTPPASADSGMCCESDSEPGTSVSEPLTPDAGSHTFASGPEEGLSYLAASEAPLPPGGPAEAIKEHERWLAMCIQALQREVAEEDLVQVDRAVDALDRWEMFTGQLPATRQDPPSSRDSVGLRKVLGDKFSSLRRKLSARKLARAESAPRPWDGEES

SEQ ID NO: 24451 - protein, 297 aa, Homo sapiens
  ENSP00000386020
MLQCRPAQEFSFGPRALKDALVSTDAALQQLYVSAFSPAERLFLAEAYNPQRTLFCTLLIRTGFDWLLSRPEAPEDFQTFHASLQHRKPRLARKHIYLQPIDLSEEPVGSSLLHQLCSCTEAFFLGLRVKCLPSVAAASIRCSSRPSRDSDRLQLHTDGILSFLKNNKPGDALCVLGLTLSDLYPHEAWSFTFSKFLPGHGHVPRALPPSGPGELPLAPLPHAGCAQPGRGPAAAPGPLSHLPEEAAACPGFQAHREVPETLHLDSGGGGDVAQPGGGGAVSVGGHPACQRRLGHVL

SEQ ID NO: 24452 - protein, 498 aa, Homo sapiens
  ENSP00000428340
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 24453 - protein, 497 aa, Homo sapiens
  ENSP00000297450
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 24454 - protein, 298 aa, Homo sapiens
  ENSP00000430750
MEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 24455 - protein, 297 aa, Homo sapiens
  ENSP00000429349
MEGKHKEELDTLKEEKENLQGLVTRQTYIIQELEKQLNRATTNNSVLQKQQLELMDTVHNLVNLCTKEVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 24456 - protein, 30 aa, Homo sapiens
  ENSP00000428908
MKSEMAQIQQNAVQNHTATMLEIGTSLLSQ

SEQ ID NO: 24457 - protein, 460 aa, Homo sapiens
  ENSP00000360170
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 24458 - protein, 198 aa, Homo sapiens
  ENSP00000422195
MVLLAGTGPEGGGARCMTPPPPSPPRGAQVEEDPADYEEFEDFSSLPDTRSIASDDSFYPFEDEEEHGVESAESVPEGVPESVPETATLLRAACANNVGLLRTLVRRGVSVEEAQETDRNGRTGLIVACYHGFVDTVVALAECPHVDVNWQDSEGNTALITAAQAGAAPVPMGIVSLDTGSQSCASGVSITWAGSCEH

SEQ ID NO: 24459 - protein, 494 aa, Homo sapiens
  ENSP00000296657
MVLLAGTGPEGGGARCMTPPPPSPPRGAQVEEDPADYEEFEDFSSLPDTRSIASDDSFYPFEDEEEHGVESAESVPEGVPESVPETATLLRAACANNVGLLRTLVRRGVSVEEAQETDRNGRTGLIVACYHGFVDTVVALAECPHVDVNWQDSEGNTALITAAQAGHAIITNYLLNYFPGLDLERRNAFGFTALMKAAMQGRTDCIRALMLAGADVHARDPRRGMSPQEWATYTGRVDAVRLMQRLLERPCPEQFWEKYRPELPPPPEAARKPAGSKNCLQRLTDCVLSVLTPRSVRGPEDGGVLDHMVRMTTSLYSPAVAIVCQTVCPESPPSVGKRRLAVQEILAARAARGPQAQEEDEVGGAGQRGRTGQEDADSREGSPRAGLPPALGSRGPAAPAPRKASLLPLQRLRRRSVRPGVVVPRVRVSKAPAPTFQPERPARKGSTKDSGHLQIPKWRYKEAKEEKRKAEEAEKKRQAEAQKERRTAPWKKRT

SEQ ID NO: 24460 - protein, 44 aa, Homo sapiens
  ENSP00000421529
MLLLDCNPEVDGLKHLLETGASVNAPPDPCKQSPVHLAAGSGLA

SEQ ID NO: 24461 - protein, 158 aa, Homo sapiens
  ENSP00000335147
MLLLDCNPEVDGLKHLLETGASVNAPPDPCKQSPVHLAAGSGLACFLLWQLQTGADLNQQDVLGEAPLHKAAKVGSLECLSLLVASDAQIDLCNKNGQTAEDLAWSCGFPDCAKFLTTIKCMQTIKASEHPDRNDCVAVLRQKRSLGSVENTSGKRKC

SEQ ID NO: 24462 - protein, 198 aa, Homo sapiens
  ENSP00000377049
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPEPP

SEQ ID NO: 24463 - protein, 85 aa, Homo sapiens
  ENSP00000432375
MNGANLTAQDDRGCTPLHLAATHGHSFTLQIMLRSGVDPSVTDKREWRPVHYAAFHGRLGCLQLLVKWGCSIEDVDYNGNLPEPP

SEQ ID NO: 24464 - protein, 517 aa, Homo sapiens
  ENSP00000260047
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMEDSASCESNKEKRRVKKKVSSGGVFVRRY

SEQ ID NO: 24465 - protein, 230 aa, Homo sapiens
  ENSP00000433585
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPGGSHLLLSIMATLRPLVKPRIIKKRTKKFFRHQTD

SEQ ID NO: 24466 - protein, 502 aa, Homo sapiens
  ENSP00000434666
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMTALLVSQTKRRGE

SEQ ID NO: 24467 - protein, 389 aa, Homo sapiens
  ENSP00000377051
MPGVANSGPSTSSRETANPCSRKKVHFGSIHDAVRAGDVKQLSEIVCLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARRPSKNCRASWSMNDYVEKN

SEQ ID NO: 24468 - protein, 527 aa, Homo sapiens
  ENSP00000435790
MPGVANSGPSTSSRETANPCSRKKVHFGSIHDAVRAGDVKQLSEIVVRGASINELDVLHKFTPLHWAAHSGSLECLHWLLWHGADITHVTTRGWTASHIAAIRGQDACVQALIMNGANLTAQDDRGCTPLHLAATHGHSFTLQIMLRSGVDPSVTDKREWRPVHYAAFHGRLGCLQLLVKWGCSIEDVDYNGNLPVHLAAMEGHLHCFKFLVSRMSSATQVLKAFNDNGENVLDLAQRFFKQNILQFIQGAEYEGKDLEDQETLAFPGHVAAFKGDLGMLKKLVEDGVININERADNGSTPMHKAAGQGHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMVGVLFNTFIFLKKYIQEWPRVQALGWGSLDLNPGYSLF

SEQ ID NO: 24469 - protein, 142 aa, Homo sapiens
  ENSP00000435197
DLGMLKKLVEDGVININERADNGSTPMHKAAGQGHIECLQWLIKMGADSNITNKAGERPSDVAKRTIKELQGQLEYERLRREKLECQLDEYRAEVDQLRETLEKIQVPNFVAMEDSASCESNKEKRRVKKKVSSGGVFVRRY

SEQ ID NO: 24470 - protein, 1124 aa, Homo sapiens
  ENSP00000265748
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKGFTECEMTKSSPLKITLFLEEDKSLKVTSDPKVEQKIEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 24471 - protein, 1087 aa, Homo sapiens
  ENSP00000379380
MDPFTEKLLERTRARRENLQRKMAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNASATPVGRRGRLANLAATICSWEDDVNHSFAKQNSVQEQPGTACLSKFSSASGASARINSSSVKQEATFCSQRDGDASLNKALSSSADDASLVNASISSSVKATSPVKSTTSITDAKSCEGQNPELLPKTPISPLKTGVSKPIVKSTLSQTVPSKGELSREICLQSQSKDKSTTPGGTGIKPFLERFGERCQEHSKESPARSTPHRTPIITPNTKAIQERLFKQDTSSSTTHLAQQLKQERQKELACLRGRFDKGNIWSAEKGGNSKSKQLETKQETHCQSTPLKKHQGVSKTQSLPVTEKVTENQIPAKNSSTEPKEVIREIEMSVDDDDINSSKVINDLFSDVLEEGELDMEKSQEEMDQALAESSEEQEDALNISSMSLLAPLAQTVGVVSPESLVSTPRLELKDTSRSDESPKPGKFQRTRVPRAESGDSLGSEDRDLLYSIDAYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRETLVSQCRDTLCVTKNWLSADTKEERDLWMQKLNQVLVDIRLWQPDACYKPIGKP

SEQ ID NO: 24472 - protein, 169 aa, Homo sapiens
  ENSP00000404979
MAERPTAAPRSMTHAKRARQPLSEASNQQPLSGGEEKSCTKPSPSKKRCSDNTEVEVSNLENKQPVESTSAKSCSPSPVSPQVQPQAADTISDSVAVPASLLGMRRGLNSRLEATAASSVKTRMQKLAEQRRRWDNDDMTDDIPESSLFSPMPSEEKAASPPRPLLSNA

SEQ ID NO: 24473 - protein, 36 aa, Homo sapiens
  ENSP00000406584
MAERPTAAPRSMTHAKRARQPLSEASNQQPLSGGEG

SEQ ID NO: 24474 - protein, 73 aa, Homo sapiens
  ENSP00000398712
KFSSASGASARINSSSVKQEATFCSQRDGDASLNKALSSSADDASLVNASISSSVCFHVSESYFSSEIYYIYH

SEQ ID NO: 24475 - protein, 69 aa, Homo sapiens
  ENSP00000397465
  MOD_RES (1)..(1): Any amino acid
XFSSASGASARINSSSVKQEATFCSQRDGDASLNKALSSSADDASLVNASISSSVVKSYFSSEIYYIYH

SEQ ID NO: 24476 - protein, 26 aa, Homo sapiens
  ENSP00000413441
  MOD_RES (1)..(1): Any amino acid
XSLVNASISSSVVKSYFSSEIYYIYH

SEQ ID NO: 24477 - protein, 236 aa, Homo sapiens
  ENSP00000413522
  MOD_RES (1)..(1): Any amino acid
XQEHSKESPARSTPHRTPIITPNTKAIQERLFKQDVSNDFEINIEVYSLVQKKDPSGLDKKKKTSKSKAITPKRLLTSITTKSNIHSSVMASPGGLSAVRTSNFALVGSYTLSLSSVGNTKFVLDKVPFLSSLEGHIYLKIKCQVNSSVEERGFLTIFEDVSGFGAWHRRWCVLSGNCISYWTYPDDEKRKNPIGRINLANCTSRQIEPANREFCARRNTFELITVRPQREDDRET

SEQ ID NO: 24478 - protein, 276 aa, Homo sapiens
  ENSP00000400777
  MOD_RES (1)..(1): Any amino acid
XPKPGKFQRTRVPRAESGDSLGSEDRDLLYRSQRFKETERPSIKQVIVRKEDVTSKLDEKNNAFPCQVNIKQKMQELNNEINMQQTVIYQASQALNCCVDEEHGKGSLEEAEAERLLLIATGKRTLLIDELNKLKNEGPQRKNKASPQSEFMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHS

SEQ ID NO: 24479 - protein, 252 aa, Homo sapiens
  ENSP00000399553
  MOD_RES (1)..(1): Any amino acid
XMPSKGSVTLSEIRLPLKADFVCSTVQKPDAANYYYLIILKAGAENMVATPLASTSNSLNGDALTFTTTFTLQDVSNDFEINIEVYSLVQKKDPSGLDKKKKTSKSKAITPKRLLTSITTKSNIHSSVMASPGGLSAVRTSNFALVGSYTLSLSSVGNTKFVLDKINYDVRERELLGYLFQEKVPFLSSLEGHIYLKIKCQVNSSVEERGFLTIFEDVSGFGAWHRRWCVLSGNCISYWTYPDDEKRKNPIG

SEQ ID NO: 24480 - protein, 176 aa, Homo sapiens
  ENSP00000469449
  MOD_RES (1)..(1): Any amino acid
XSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 24481 - protein, 176 aa, Homo sapiens; identical to SEQ ID NO: 24480
  ENSP00000470039
  MOD_RES (1)..(1): Any amino acid

SEQ ID NO: 24482 - protein, 176 aa, Homo sapiens; identical to SEQ ID NO: 24480
  ENSP00000471431
  MOD_RES (1)..(1): Any amino acid

SEQ ID NO: 24483 - protein, 190 aa, Homo sapiens
  ENSP00000449116
MEASSSGITNGKTKVFHPEGGVDLQGYQLDMQILPDGPKSDVDFSEILNAIQEMAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFSSNCN

SEQ ID NO: 24484 - protein, 11 aa, Homo sapiens
  ENSP00000447867
MEASSSGITNG

SEQ ID NO: 24485 - protein, 920 aa, Homo sapiens
  ENSP00000376705
MEASSSGITNGKTKVFHPVAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 24486 - protein, 955 aa, Homo sapiens
  ENSP00000376703
MEASSSGITNGKTKVFHPEGGVDLQGYQLDMQILPDGPKSDVDFSEILNAIQEMAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 24487 - protein, 475 aa, Homo sapiens
  ENSP00000450192
MAVWATVFLEFWKRRRAVIAYDWDLIDWEEEEICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 24488 - protein, 929 aa, Homo sapiens
  ENSP00000391417
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEYLALLPRLGHSGMILAHCNLRLPVDCCMCYRFVDEIRLLEQLTSDFIDSLYYIFSISIISIFFSVTFFFLLLSLGPTPCFSVSNFLS

SEQ ID NO: 24489 - protein, 931 aa, Homo sapiens
  ENSP00000409126
MKKMSRNVLLQMEEEEDDDDGDIGDVPASRRPFLTPHTHLPSSLVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 24490 - protein, 45 aa, Homo sapiens
  ENSP00000449423
MKKMSRNVLLQMEEEEDDDDGDIGLKCSSGVAQSWLTVALTPRLN

SEQ ID NO: 24491 - protein, 910 aa, Homo sapiens
  ENSP00000320087
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 24492 - protein, 892 aa, Homo sapiens
  ENSP00000413137
MFCAAVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 24493 - protein, 323 aa, Homo sapiens
  ENSP00000264908
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 24494 - protein, 284 aa, Homo sapiens
  ENSP00000423068
MLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 24495 - protein, 55 aa, Homo sapiens
  ENSP00000426591
MASIWGRRDESLKVDEHLAKQDAQILYKAGENRWGTDEDKFTEILCLRSFPQLKL

SEQ ID NO: 24496 - protein, 284 aa, Homo sapiens; identical to SEQ ID NO: 24494
  ENSP00000421015

SEQ ID NO: 24497 - protein, 104 aa, Homo sapiens
  ENSP00000424584
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMK

SEQ ID NO: 24498 - protein, 154 aa, Homo sapiens
  ENSP00000421512
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRK

SEQ ID NO: 24499 - protein, 134 aa, Homo sapiens
  ENSP00000422281
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYT

SEQ ID NO: 24500 - protein, 1338 aa, Homo sapiens
  ENSP00000363832
MDRASELLFYVNGRKVIEKNVDPETMLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKENGVCCLDQGINGLPEFEEGSKTSPKLFAEEEFLPLDPTQELIFPPELMIMAEKQSQRTRVFGSERMMWFSPVTLKELLEFKFKYPQAPVIMGNTSVGPEVKFKGVFHPVIISPDRIEELSVVNHAYNGLTLGAGLSLAQVKDILADVVQKLPEEKTQMYHALLKHLGTLAGSQIRNMASLGGHIISRHPDSDLNPILAVGNCTLNLLSKEGKRQIPLNEQFLSKCPNADLKPQEILVSVNIPYSRKWEFVSAFRQAQRQENALAIVNSGMRVFFGEGDGIIRELCISYGGVGPATICAKNSCQKLIGRHWNEQMLDIACRLILNEVSLLGSAPGGKVEFKRTLIISFLFKFYLEVSQILKKMDPVHYPSLADKYESALEDLHSKHHCSTLKYQNIGPKQHPEDPIGHPIMHLSGVKHATGEAIYCDDMPLVDQELFLTFVTSSRAHAKIVSIDLSEALSMPGVVDIMTAEHLSDVNSFCFFTEAEKFLATDKVFCVGQLVCAVLADSEVQAKRAAKRVKIVYQDLEPLILTIEESIQHNSSFKPERKLEYGNVDEAFKVVDQILEGEIHMGGQEHFYMETQSMLVVPKGEDQEMDVYVSTQFPKYIQDIVASTLKLPANKVMCHVRRVGGAFGGKVLKTGIIAAVTAFAANKHGRAVRCVLERGEDMLITGGRHPYLGKYKAGFMNDGRILALDMEHYSNAGASLDESLFVIEMGLLKMDNAYKFPNLRCRGWACRTNLPSNTAFRGFGFPQAALITESCITEVAAKCGLSPEKVRIINMYKEIDQTPYKQEINAKNLIQCWRECMAMSSYSLRKVAVEKFNAENYWKKKGLAMVPLKFPVGLGSRAAGQAAALVHIYLDGSVLVTHGGIEMGQGVHTKMIQVVSRELRMPMSNVHLRGTSTETVPNANISGGSVVADLNGLAVKDACQTLLKRLEPIISKNPKGTWKDWAQTAFDESINLSAVGYFRGYESDMNWEKGEGQPFEYFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPGSYVPWNVPI

SEQ ID NO: 24501 - protein, 151 aa, Homo sapiens
  ENSP00000392485
MLLPYLRKKLRLTGTKYGCGGGGCGACTVMISRYNPITKRIRHHPANACLIPICSLYGAAVTTVEGIGSTHTRIHPVQERIAKCHGTQCGFCTPGMVMSIYTLLRNHPEPTLDQLTDALGGNLCRCTGYRPIIDACKTFCKTSGCCQSKEN

SEQ ID NO: 24502 - protein, 193 aa, Homo sapiens
  ENSP00000260930
SKNPKGTWKDWAQTAFDESINLSAVGYFRGYESDMNWEKGEGQPFEYFVYGAACSEVEIDCLTGDHKNIRTDIVMDVGCSINPAIDIGQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMIPRDEPG

SEQ ID NO: 24503 - protein, 190 aa, Homo sapiens
  ENSP00000413326
YFVYGAACSEVEIDCLTGDHKNIRTDIVMDVGCSINPAIDIGQIEGAFIQGMGLYTIEELNYSPQGILHTRGPDQYKIPAICDMPTELHIALLPPSQNSNTLYSSKGLGESGVFLGCSVFFAIHDAVSAARQERGLHGPLTLNSPLTPEKIRMACEDKFTKMGAHGKPVRRTQEQVLLIQLHKIQPMLVA

SEQ ID NO: 24504 - protein, 164 aa, Homo sapiens
  ENSP00000397155
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQENRLSPRGRDCSEPRSCHCTLA

SEQ ID NO: 24505 - protein, 104 aa, Homo sapiens
  ENSP00000401705
MIHFILLFSRQGKLRLQKWYITLPDKERKKITREIVQIILSRGHRTSSFVDWKELKLVYKRYASLYFCCAIENQDNELLTLEIVHRYVELLDKYFGNTWPFARA

SEQ ID NO: 24506 - protein, 81 aa, Homo sapiens
  ENSP00000333888
MIHFILLFSRQGKLRLQKWYITLPDKERKKITREIVQIILSRGHRTSSFVDWKELKLVYKRSVSWILSLILKRLISSWTSL

SEQ ID NO: 24507 - protein, 154 aa, Homo sapiens
  ENSP00000379891
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQETMEEYMNKPTF

SEQ ID NO: 24508 - protein, 63 aa, Homo sapiens
  ENSP00000379890
MIHFILLFSRQGKLRLQKWYITLPDKERKKITREIVQIILSRGHRTSSFVDWKELKLVYKRCL

SEQ ID NO: 24509 - protein, 154 aa, Homo sapiens
  ENSP00000388738
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQEVSTVSQTMGER

SEQ ID NO: 24510 - protein, 56 aa, Homo sapiens
  ENSP00000399738
MISFLDEERLGGGGGDCIFVGKTVSRLLNVCELDIIFNFEKAYFILDEFIIGGEIQ

SEQ ID NO: 24511 - protein, 137 aa, Homo sapiens
  ENSP00000387199
MIHFILLFSRQGKLRLQKWYITLPDKERKKITREIVQIILSRGHRTSSFVDWKELKLVYKRYASLYFCCAIENQDNELLTLEIVHRYVELLDKYFGNEFNCWFLLMRLLSVLDSWSTPALNSEVPQLATITPDFCLF

SEQ ID NO: 24512 - protein, 70 aa, Homo sapiens
  ENSP00000488632
MAHRKLESVGSGMLDHRVRPGPVPHSQEPESEDMELPLEGYVPEGLELAALRPESPAPEEQECHNHSPDG

SEQ ID NO: 24513 - protein, 4 aa, Homo sapiens
  ENSP00000488322
MAHR

SEQ ID NO: 24514 - protein, 737 aa, Homo sapiens
  ENSP00000483174
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKNSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 24515 - protein, 749 aa, Homo sapiens
  ENSP00000488107
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKRMQKAAKIKKKANSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 24516 - protein, 749 aa, Homo sapiens; identical to SEQ ID NO: 24515
  ENSP00000480384

SEQ ID NO: 24517 - protein, 112 aa, Homo sapiens
  ENSP00000488620
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLE

SEQ ID NO: 24518 - protein, 27 aa, Homo sapiens
  ENSP00000488031
MAHRKLESVGSGMLDHRVRPGPVPHSQ

SEQ ID NO: 24519 - protein, 263 aa, Homo sapiens
  ENSP00000487880
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVE

SEQ ID NO: 24520 - protein, 749 aa, Homo sapiens; identical to SEQ ID NO: 24515
  ENSP00000453144

SEQ ID NO: 24521 - protein, 749 aa, Homo sapiens; identical to SEQ ID NO: 24515
  ENSP00000453293

SEQ ID NO: 24522 - protein, 737 aa, Homo sapiens; identical to SEQ ID NO: 24514
  ENSP00000452722

SEQ ID NO: 24523 - protein, 4 aa, Homo sapiens
  ENSP00000452699
MAHR

SEQ ID NO: 24524 - protein, 70 aa, Homo sapiens; identical to SEQ ID NO: 24512
  ENSP00000454001

SEQ ID NO: 24525 - protein, 112 aa, Homo sapiens; identical to SEQ ID NO: 24517
  ENSP00000453034

SEQ ID NO: 24526 - protein, 27 aa, Homo sapiens
  ENSP00000453981
MAHRKLESVGSGMLDHRVRPGPVPHSQ

SEQ ID NO: 24527 - protein, 263 aa, Homo sapiens; identical to SEQ ID NO: 24519
  ENSP00000453715

SEQ ID NO: 24528 - protein, 749 aa, Homo sapiens; identical to SEQ ID NO: 24515
  ENSP00000454171

SEQ ID NO: 24529 - protein, 737 aa, Homo sapiens; identical to SEQ ID NO: 24514
  ENSP00000409312

SEQ ID NO: 24530 - protein, 758 aa, Homo sapiens
  ENSP00000295974
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 24531 - protein, 736 aa, Homo sapiens
  ENSP00000426018
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 24532 - protein, 728 aa, Homo sapiens
  ENSP00000427307
  MOD_RES (1)..(1): Any amino acid
XDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETADIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 24533 - protein, 759 aa, Homo sapiens
  ENSP00000427211
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETADIWSDHSFQTDPDLPPGWKRVSDIAGTYYWHIPTGTTQWERPVSIPADLQGSRKGSLSSVTPSPTPENEKQPWSDFAVLNGGKINSDIWKDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 24534 - protein, 210 aa, Homo sapiens
  ENSP00000425802
MAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 24535 - protein, 737 aa, Homo sapiens
  ENSP00000421539
MSEVLPADSGVDTLAVFMASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRRTKSFLNYYADLETSARELEQNRGNHHGTAEEKSQPVQGQASTIIGNGDLLLQKPNRPQSSPEDGQVATVSSSPETKKDHPKTGAKTDCALHRIQNLAPSDEESSWTTLSQDSASPSSPDETDIWSDHSFQTDPDLPPGWKRVSDIAGTYYWHIPTGTTQWERPVSIPADLQGSRKGSLSSVTPSPTPENEDLHAATVNPDPSLKEFEGATLRYASLKLRNAPHPDDDDSCSINSDPEAKCFAVRSLGWVEMAEEDLAPGKSSVAVNNCIRQLSYCKNDIRDTVGIWGEGKDMYLILENDMLSLVDPMDRSVLHSQPIVSIRVWGVGRDNGRDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKDVHTFAFIMDTGNQRFECHVFWCEPNAGNVSEAVQAACMLRYQKCLVARPPSQKVRPPPPPADSVTRRVTTNVKRGVLSLIDTLKQKRPVTEMP

SEQ ID NO: 24536 - protein, 210 aa, Homo sapiens; identical to SEQ ID NO: 24534
  ENSP00000423765

SEQ ID NO: 24537 - protein, 41 aa, Homo sapiens
  ENSP00000422948
  MOD_RES (1)..(1): Any amino acid
XDTPAKAIATSLHEICSKVRLWLNGRMPKRWPAAPYRKGPM

SEQ ID NO: 24538 - protein, 179 aa, Homo sapiens
  ENSP00000426429
VLHSQPIVSIRVWGVGRDNGRERDFAYVARDKDTRILKCHVFRCDTPAKAIATSLHEICSKIMAERKNAKALACSSLQERANVNLDVPLQVDFPTPKTELVQKFHVQYLGMLPVDKPVGMDILNSAIENLMTSSNKEDWLSVNMNVADATVTVISEKNEEEVLVECRVRFLSFMGVGKD

SEQ ID NO: 24539 - protein, 102 aa, Homo sapiens
  ENSP00000427107
MAERKNAKALACSSLQERANVNLDVPLQVDFPTPKTELVQKFHVQYLGMLPVDKPVGMDILNSAIENLMTSSNKEDWLSVNMNVADATVTVISEKNEEEVLV

SEQ ID NO: 24540 - protein, 95 aa, Homo sapiens
  ENSP00000421751
MAERKNAKALACSSLQERANVNLDVPLQVDFPTPKTELVQKFHVQYLGMLPVDKPVGMDILNSAIENLMTSSNKEDWLSVNMNVADATVTVISEK

SEQ ID NO: 24541 - protein, 87 aa, Homo sapiens
  ENSP00000421301
MAERKNAKALACSSLQERANVNLDVPLQVDFPTPKTELVQKFHVQYLGMLPVDKPVGMDILNSAIENLMTSSNKEDWLSVNMNVADA

SEQ ID NO: 24542 - protein, 142 aa, Homo sapiens
  ENSP00000425121
  MOD_RES (1)..(1): Any amino acid
XGEGKDMYLILENDMLSLVDPMDRSVLHSQPIVSIRVWGVGRDNGRERDFAYVARDKDTRILKCHVFRCDTPAKAIATSLHEICSKIMAERKNAKALACSSLQERANVNLDVPLQDFPTPKTELVQKFHVQYLGMLPVDKPV

SEQ ID NO: 24543 - protein, 140 aa, Homo sapiens
  ENSP00000424414
MASSGTTDVTNRNSPATPPNTLNLRSSHNELLNAEIKHTETKNSTPPKCRKKYALTNIQAAMGLSDPAAQPLLGNGSANIKLVKNGENQLRKAAEQGQQDPNKNLSPTAVINITSEKLEGKEPHPQDSSSCEILPSQPRR

SEQ ID NO: 24544 - protein, 68 aa, Homo sapiens
  ENSP00000424579
MSEVLPADSGVDTLAVFMASSGTTDVTNRNSPATPPNTLNLRSSHNELLNAEIKHTETKNSTPPKCRK

SEQ ID NO: 24545 - protein, 26 aa, Homo sapiens
  ENSP00000425202
MASSGTTDVTNRNSPATPPNTLNLRS

SEQ ID NO: 24546 - protein, 27 aa, Homo sapiens
  ENSP00000422723
MSEVLPADSGVDTLAVFMASSGTTDVT

SEQ ID NO: 24547 - protein, 10 aa, Homo sapiens
  ENSP00000421205
MSEVLPADSG

SEQ ID NO: 24548 - protein, 210 aa, Homo sapiens; identical to SEQ ID NO: 24534
  ENSP00000439357

SEQ ID NO: 24549 - protein, 514 aa, Homo sapiens
  ENSP00000347433
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 24550 - protein, 61 aa, Homo sapiens
  ENSP00000404930
MSWPRRLLLRYLFPALLLHEPRPCLHRLSDHLSVRRAPPSHPAPKGRPDHRPARGVGEPAL

SEQ ID NO: 24551 - protein, 22 aa, Homo sapiens
  ENSP00000463110
MSWPRRLLLRYLFPALLLHAVK

SEQ ID NO: 24552 - protein, 184 aa, Homo sapiens
  ENSP00000463104
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQGHGRHRVRVQSESHEGHPHGCGHSLTAQRLQRE

SEQ ID NO: 24553 - protein, 227 aa, Homo sapiens
  ENSP00000476491
  MOD_RES (1)..(1): Any amino acid
XDVAYDLWREENGCECTKAVNFAMHELQLIRVEKQYLHHNLDHLVEELFLGDIHTDATQRMFYRPSSYQPPLQNAKCAAESSGSFQILPQDSSEKEQNGLSHWCLSRPGHQKDWALCAHAGPATAGCPSCLWPPAETGRKAGRTSSKTVHACPGEAGTSSFELFYFPNCWSIETKLKISLNAKLSFKPRASAPLETGHRVKIETLSQLVFLSFIQLCCEVQSPLANK

SEQ ID NO: 24554 - protein, 94 aa, Homo sapiens
  ENSP00000464649
PEDVLPALQLPAPSAECQVEMGFHHVGQDGLQLPTSSDPPALASQSAGITGVSHRPPGRHLSNDLRTTTMPASPVGSSIGQTSTTLPSCPQRQT

SEQ ID NO: 24555 - protein, 518 aa, Homo sapiens
  ENSP00000364126
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 24556 - protein, 188 aa, Homo sapiens
  ENSP00000453002
MARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCL

SEQ ID NO: 24557 - protein, 257 aa, Homo sapiens
  ENSP00000261879
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 24558 - protein, 216 aa, Homo sapiens
  ENSP00000369700
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 24559 - protein, 81 aa, Homo sapiens
  ENSP00000369697
MTAAVFFGCAFIAFGPALALYVFTIATEPLRIIFLIAGRRVETCKNTEAPDCASPSGSLSFLLVGVSTDFVPCLVHGKSHY

SEQ ID NO: 24560 - protein, 222 aa, Homo sapiens
  ENSP00000453327
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSDLHKFLLWNKPGVSIYNPGAHGHLGILSCGRQLPKPETLPALPRQELSSLQPALQITSGNQHF

SEQ ID NO: 24561 - protein, 19 aa, Homo sapiens
  ENSP00000453516
LYVFTIATEPLRIIFLIAG

SEQ ID NO: 24562 - protein, 380 aa, Homo sapiens
  ENSP00000257254
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 24563 - protein, 380 aa, Homo sapiens; identical to SEQ ID NO: 24562
  ENSP00000475344

SEQ ID NO: 24564 - protein, 380 aa, Homo sapiens; identical to SEQ ID NO: 24562
  ENSP00000477818

SEQ ID NO: 24565 - protein, 611 aa, Homo sapiens
  ENSP00000441501
MLASLEKDKTAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 24566 - protein, 651 aa, Homo sapiens
  ENSP00000221891
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDADTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 24567 - protein, 118 aa, Homo sapiens
  ENSP00000466623
MGPASPAARGLSRRPGQPPLPLLLPLLLLLLRAQPAIGSLAGGSPGAAETHSALDAVSGTRSACWSTADRCTRSCRLHVWSRLRRPSPWSAGAGVPGAAAAPTPTTRLCPSAACLVNL

SEQ ID NO: 24568 - protein, 644 aa, Homo sapiens
  ENSP00000465694
MEAVCGAWGRGLVLGVSVLGSKEPGDPHANAPRALTVLSTSIQAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 24569 - protein, 173 aa, Homo sapiens
  ENSP00000466116
MYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETV

SEQ ID NO: 24570 - protein, 294 aa, Homo sapiens
  ENSP00000467854
MYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAA

SEQ ID NO: 24571 - protein, 221 aa, Homo sapiens
  ENSP00000466576
  MOD_RES (1)..(1): Any amino acid
XEWAMADNQSKNLPKADRQALNEAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLL

SEQ ID NO: 24572 - protein, 289 aa, Homo sapiens
  ENSP00000474762
  MOD_RES (1)..(1): Any amino acid
XQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 24573 - protein, 189 aa, Homo sapiens
  ENSP00000345179
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 24574 - protein, 108 aa, Homo sapiens
  ENSP00000391597
MVMLLLLLSALAGLFGAAEGQAFHLGKCPNPPVQENFDVNKTESHFVTQGGVQHHHLGSLQPPPPGFKQFSCLSLPSSWDYSISEDGTKLRRSQQPLRMDAASRPTTH

SEQ ID NO: 24575 - protein, 215 aa, Homo sapiens
  ENSP00000415235
MFKQLSCISLPSSCDYSSRSLLQPPSPKMVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPK

SEQ ID NO: 24576 - protein, 149 aa, Homo sapiens
  ENSP00000393076
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWIL

SEQ ID NO: 24577 - protein, 664 aa, Homo sapiens
  ENSP00000258530
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 24578 - protein, 235 aa, Homo sapiens
  ENSP00000449410
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQR

SEQ ID NO: 24579 - protein, 621 aa, Homo sapiens
  ENSP00000444472
MQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 24580 - protein, 107 aa, Homo sapiens
  ENSP00000447828
MSLLQPGPVFPSGNSENSDLTVLPNHICSKILSFSTFANHYFSCLLQICYAINLGKEIIEVQKDPEALAQLMLSIPLTNDGKYVLLNDQPDDDDGNPNEHRGAESEA

SEQ ID NO: 24581 - protein, 670 aa, Homo sapiens
  ENSP00000446917
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNDVCLFLEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELLSVDESVYTPDSDVAAPQINRNLIQKAGYLNLRNKTGLVTTTWERLYFFTQGGNLMCQPRGAVAGGLIQDLDNCSVMAVDCEDRRYCFQITTPNGKSGIILQAESRKENEEWICAINNISRQIYLTDNPEAVAIKLNQTALQAVTPITSFGKKQESSCPSQNLKNSEMENENDKIVPKATASLPEAEELIAPGTPIQFDIVLPATEFLDQNRGSRRTNPFGETEDESFPEAEDSLLQQMFIVRFLGSMAVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEHRGAESEA

SEQ ID NO: 24582 - protein, 188 aa, Homo sapiens
  ENSP00000446510
DIVLPATEFLDQNRGSRRTNPFGETEDESFPEAEVKTDSTTEVIYEAMRQVLAARAIHNIFRMTESHLMVTSQSLRLIDPQTQVSRANFELTSVTQFAAHQENKRLVGFVIRVPESTGEESLSTYIFESNSEGEKICYAINLGKEIIEVQKDPEALAQLMLSIPLTNDGKYVLLNDQPDDDDGNPNEH

SEQ ID NO: 24583 - protein, 39 aa, Homo sapiens
  ENSP00000448569
MVLPIIQFREKDLTEVSTLKDLFGLASNAGCLRKRRMRR

SEQ ID NO: 24584 - protein, 144 aa, Homo sapiens
  ENSP00000449767
MPAVDKLLLEEALQDSPQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLS

SEQ ID NO: 24585 - protein, 61 aa, Homo sapiens
  ENSP00000447520
MQRVYGAQNEMCLATQQLSKQLLAYEKQNFALGKGDEEVISTLHYFSKVVDELNLLHTELA

SEQ ID NO: 24586 - protein, 323 aa, Homo sapiens
  ENSP00000372654
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 24587 - protein, 301 aa, Homo sapiens
  ENSP00000462597
MVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 24588 - protein, 301 aa, Homo sapiens; identical to SEQ ID NO: 24587
  ENSP00000393121

SEQ ID NO: 24589 - protein, 185 aa, Homo sapiens
  ENSP00000462075
MSDRPTARRWGLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGN

SEQ ID NO: 24590 - protein, 98 aa, Homo sapiens
  ENSP00000372656
MSDRPTARRWGVDLCVPERTSWWLSKGSGLKLSGKQSQRNFWPCLFLFSSAWDPPSTGVEQKSLYRSTWFSSPFALDSALQPWCSALAISAVATSTLQ

SEQ ID NO: 24591 - protein, 296 aa, Homo sapiens
  ENSP00000484446
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 24592 - protein, 341 aa, Homo sapiens
  ENSP00000368821
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 24593 - protein, 51 aa, Homo sapiens
  ENSP00000441619
MVQASGHRRSTRGSKMVSWSVIAKIQEILQRKMVREFLAEFMSTYVMMEPT

SEQ ID NO: 24594 - protein, 216 aa, Homo sapiens
  ENSP00000396111
MVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRWHHLPGLHWLHHPTGAPEIGGFCGV

SEQ ID NO: 24595 - protein, 342 aa, Homo sapiens
  ENSP00000297988
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 24596 - protein, 169 aa, Homo sapiens
  ENSP00000410138
MNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAP

SEQ ID NO: 24597 - protein, 256 aa, Homo sapiens
  ENSP00000368820
MGSGHCLRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 24598 - protein, 257 aa, Homo sapiens
  ENSP00000485332
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 24599 - protein, 41 aa, Homo sapiens
  ENSP00000485131
MVQASGHRRGLLAPWIALSAPHPPICKVASLVCHFYWSSPN

SEQ ID NO: 24600 - protein, 51 aa, Homo sapiens; identical to SEQ ID NO: 24593
  ENSP00000485224

SEQ ID NO: 24601 - protein, 165 aa, Homo sapiens
  ENSP00000412868
MNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFRYCPCPGPFL

SEQ ID NO: 24602 - protein, 85 aa, Homo sapiens
  ENSP00000485348
MVQASGHRRSTRGSKMVSWSVIAKIQEILQRKMVREFLAEFMSTYVMMREGDDWFGVGEESTCLRGLWKTESGRLCQQKMWAKRR

SEQ ID NO: 24603 - protein, 84 aa, Homo sapiens
  ENSP00000485419
MGSGHCLRSTRGSKMVSWSVIAKIQEILQRKMVREFLAEFMSTYVMMREGDDWFGVGEESTCLRGLWKTESGRLCQQKMWAKRR

SEQ ID NO: 24604 - protein, 80 aa, Homo sapiens
  ENSP00000485081
MVQASGHRRSTRGSKMVSWSVIAKIQEILQRKMVREFLAEFMSTYVMMAWLTGMLQLCLFAITDQENNPALPGTEALVIG

SEQ ID NO: 24605 - protein, 50 aa, Homo sapiens
  ENSP00000485246
MVQASGHRRSTRGSKMVSWSVIAKIQEILQRKMVREFLAEFMSTYVMMRE

SEQ ID NO: 24606 - protein, 295 aa, Homo sapiens
  ENSP00000441390
MQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 24607 - protein, 295 aa, Homo sapiens; identical to SEQ ID NO: 24606
  ENSP00000219919

SEQ ID NO: 24608 - protein, 230 aa, Homo sapiens
  ENSP00000452673
MAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 24609 - protein, 920 aa, Homo sapiens
  ENSP00000363822
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 24610 - protein, 644 aa, Homo sapiens
  ENSP00000421155
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGEKFRVGNCKHLKMTRP

SEQ ID NO: 24611 - protein, 600 aa, Homo sapiens
  ENSP00000425199
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGFFRMNKLKES

SEQ ID NO: 24612 - protein, 388 aa, Homo sapiens
  ENSP00000379358
MILWLHSLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 24613 - protein, 642 aa, Homo sapiens
  ENSP00000482407
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGFFRMNKLKESSDTNPKPYCMAAPMGLTENNRNRKKSYRETNLKAVSWPLNHT

SEQ ID NO: 24614 - protein, 572 aa, Homo sapiens
  ENSP00000479013
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRNTRRKRLWKLIIRSINSCICSPRETEVPVRQQK

SEQ ID NO: 24615 - protein, 737 aa, Homo sapiens
  ENSP00000484033
MQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIKANLFARIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 24616 - protein, 734 aa, Homo sapiens
  ENSP00000379359
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPDCERAASVHF

SEQ ID NO: 24617 - protein, 1375 aa, Homo sapiens
  ENSP00000421826
MEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 24618 - protein, 1544 aa, Homo sapiens
  ENSP00000239440
MAAPQDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEGEEPWFPPAPDGSCPGLLPSDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLRRLHNRRTLSMFFPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 24619 - protein, 1193 aa, Homo sapiens
  ENSP00000421468
MTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQSWAAALQEAVTETLSDYEVAEKIWSNRANRQCADCGSSRPDWAAVNLGVVICKQCAGQHRALGSGISKVQSLKLDTSVWSNEIVQLFIVLGNDRANRFWAGTLPPGEGLHPDATPGPRGEFISRKYRLGLFRKPHPQYPDHSQLLQALCAAVARPNLLKNMTQLLCVEAFEGEEPWFPPAPDGSCPGLLPSDPSPGVYNEVVVRATYSGFLYCSPVSNKAGPSPPRRGRDAPPRLWCVLGAALEMFASENSPEPLSLIQPQDIVCLGVSPPPTDPGDRFPFSFELILAGGRIQHFGTDGADSLEAWTSAVGKWFSPLSCHQLLGPGLLRLGRLWLRSPSHTAPAPGLWLSGFGLLRGDHLFLCSAPGPGPPAPEDMVHLRRLQEISVVSAADTPDKKEHLVLVETGRTLYLQGEGRLDFTAWNAAIGGAAGGGGTGLQEQQMSRGDIPIIVDACISFVTQHGLRLEGVYRKGGARARSLRLLAEFRRDARSVKLRPGEHFVEDVTDTLKRFFRELDDPVTSARLLPRWREAAELPQKNQRLEKYKDVIGCLPRVNRRTLATLIGHLYRVQKCAALNQMCTRNLALLFAPSVFQTDGRGEHEVRVLQELIDGYISVFDIDSDQVAQIDLEVSLITTWKDVQLSQAGDLIMEVYIEQQLPDNCVTLKVSPTLTAEELTNQVLEMRGTAAGMDLWVTFEIREHGELERPLHPKEKVLEQALQWCQLPEPCSASLLLKKVPLAQAGCLFTGIRRESPRVGLLRCREEPPRLLGSRFQERFFLLRGRCLLLLKEKKSSKPEREWPLEGAKVYLGIRKKLKPPTPWGFTLILEKMHLYLSCTDEDEMWDWTTSILKAQHDDQQPVVLRRHSSSDLARQKFGTMPLLPIRGDDSGATLLSANQTLPMKSSQGSVEEQEELEEPVYEEPVYEEVGAFPELIQDTSTSFSTTREWTVKPENPLTSQKSLDQPFLSKSSTLGQEERPPEPPPGPPSKSSPQARGSLEEQLLQELSSLILRKGETTAGLGSPSQPSSPQSPSPTGLPTQTPGFPTQPPCTSSPPSSQPLT

SEQ ID NO: 24620 - protein, 473 aa, Homo sapiens
  ENSP00000421148
MAAPQDLDIAVWLATVHLEQYADTFRRHGLATAGAARGLGHEELKQLGISATGHRKRILRLLQTGTEEGSLDPKSDSAMEPSPSPAPQAQPPKPVPKPRTVFGGLSGPATTQRPGLSPALGGPGVSRSPEPSPRPPPLPTSSSEQSSALNTVEMMPNSIYFGLDSRGRAQAAQDKAPDSSQISAPTPALRPTTGTVHIMDPGCLYYGVQPVGTPGAPDRRESRGVCQGRAEHRLSRQDLEAREDAGYASLELPGDSTLLSPTLETEETSDDLISPYASFSFTADRLTPLLSGWLDKLSPQGNYVFQRRFVQFNGRSLMYFGSDKDPFPKGVIPLTAIEMTRSSKDNKFQVITGQRVFVFRTESEAQRDMWCSTLQSCLKEQRLLGHPRPPQPPRPLRTGMLELRGHKAKVFAALSPGELALYKSEQAFSLGIGICFIELQGCSVRETKSRSFDLLTPHRCFSFTAESGGARQS

SEQ ID NO: 24621 - protein, 1375 aa, Homo sapiens; identical to SEQ ID NO: 24617
  ENSP00000486980

SEQ ID NO: 24622 - protein, 396 aa, Homo sapiens
  ENSP00000349022
MELDHRTSGGLHAYPGPRGGQVAKPNVILQIGKCRAEMLEHVRRTHRHLLAEVSKQVERELKGLHRSVGKLESNLDGYVPTSDSQRWKKSIKACLCRCQETIANLERWVKREMHVWREVFYRLERWADRLESTGGKYPVGSESARHTVSVGVGGPESYCHEADGYDYTVSPYAITPPPAAGELPGQEPAEAQQYQPWVPGEDGQPSPGVDTQIFEDPREFLSHLEEYLRQVGGSEEYWLSQIQNHMNGPAKKWWEFKQGSVKNWVEFKKEFLQYSEGTLSREAIQRELDLPQKQGEPLDQFLWRKRDLYQTLYVDADEEEIIQYVVGTLQPKLKRFLRHPLPKTLEQLIQRGMEVQDDLEQAAEPAGPHLPVEDEAETLTPAPNSESVASDRTQPE

SEQ ID NO: 24623 - protein, 180 aa, Homo sapiens
  ENSP00000306010
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCATQGTGLYEGLDWLSNELSKR

SEQ ID NO: 24624 - protein, 153 aa, Homo sapiens
  ENSP00000417501
MGLTISSLFSRLFGKKQMRILMGFNVETVEYKNICFTVWDVGGQDRIRPLWKHYFQNTQGLIFVVDSNDRERIQEVADELQKMLLVDELRDAVLLLFANKQDLPNAMAISEMTDKLGLQSLRNRTWYVQATCATQGTGLYEGLDWLSNELSKR

SEQ ID NO: 24625 - protein, 71 aa, Homo sapiens
  ENSP00000475828
MLLVDELRDAVLLLFANKQDLPNAMAISEMTDKLGLQSLRNRTWYVQATCATQGTGLYEGLDWLSNELSKR

SEQ ID NO: 24626 - protein, 59 aa, Homo sapiens
  ENSP00000420655
MGLTISSLFSRLFGKKQMRILMVGLDAAGKTTILYKLKLGEIVTTIPTIAVIFVFLCRF

SEQ ID NO: 24627 - protein, 127 aa, Homo sapiens
  ENSP00000420254
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRERIQEVADELQKMLLVDELRDAVLLLFANK

SEQ ID NO: 24628 - protein, 22 aa, Homo sapiens
  ENSP00000418388
MGLTISSLFSRLFGKKQMRILM

SEQ ID NO: 24629 - protein, 354 aa, Homo sapiens
  ENSP00000261783
MSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 24630 - protein, 786 aa, Homo sapiens
  ENSP00000336923
MGLQPLEFSDCYLDSPWFRERIRAHEAELERTNKFIKELIKDGKNLIAATKSLSVAQRKFAHSLRDFKFEFIGDAVTDDERCIDASLREFSNFLKNLEEQREIMALSVTETLIKPLEKFRKEQLGAVKEEKKKFDKETEKNYSLIDKHLNLSAKKKDSHLQEADIQVEQNRQHFYELSLEYVCKLQEIQERKKFEFVEPMLSFFQGMFTFYHQGHELAKDFNHYKMELQINIQNTRNRFEGTRSEVEELMNKIRQNPKDHKRASQFTAEGYLYVQEKRPAPFGSSWVKHYCMYRKAAKKFNMIPFEHRSGGKLGDGEVFFLKECTKRHTDSIDRRFCFDIEAADRPGVSLTMQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIPGQTRSSMVQWLNPQSPTTTSSNSAVTPLSPGSSPFPFSPPATVADKPPESIRSRKARAVYPCEAEHSSELSFEIGAIFEDVQTSREPGWLEGTLNGKRGLIPQNYVKLL

SEQ ID NO: 24631 - protein, 413 aa, Homo sapiens
  ENSP00000422358
  MOD_RES (1)..(1): Any amino acid
XCTKRHTDSIDRRFCFDIEAADRPGVSLTMQAFSEEERKQWLEALGGKEALSHSFNTAIIPRPEGNAQLDKMGFTIIRKCISAVETRGINDQGLYRVVGVSSKVQRLLSMLMDVKTCNEVDLENSADWEVKTITSALKQYLRSLPEPLMTYELHGDFIVPAKSGSPESRVNAIHFLVHKLPEKNKEMLDILVKHLTNVSNHSKQNLMTVANLGVVFGPTLMRPQEETVAALMDLKFQNIVVEILIENHEKIFRTPPDTTFPEPTCLSASPPNAPPRQSKRQGQRTKRPVAVYNLCLELEDGDNPYPSKEDTPTSSLDSLSSPSPVTTAVPGPPGPDKNHLLADGGSFGDWASTIIRSRKARAVYPCEAEHSSELSFEIGAIFEDVQTSREPGWLEGTLNGKRGLIPQNYVKLL

SEQ ID NO: 24632 - protein, 138 aa, Homo sapiens
  ENSP00000386560
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMSFCLMCSGGT

SEQ ID NO: 24633 - protein, 475 aa, Homo sapiens
  ENSP00000295095
MQKSTNSDTSVETLNSTRQGTGAVQMRIKNANSHHDRLSQSKSMILTDVGKVTEPISRHRRNHSQHILKDVIPPLEQLMVEKEGYLQKAKIADGGKKLRKNWSTSWIVLSSRRIEFYKESKQQALSNMKTGHKPESVDLCGAHIEWAKEKSSRKNVFQITTVSGNEFLLQSDIDFIILDWFHAIKNAIDRLPKDSSCPSRNLELFKIQRSSSTELLSHYDSDIKEQKPEHRKSLMFRLHHSASDTSDKNRVKSRLKKFITRRPSLKTLQEKGLIKDQIFGSHLHKVCERENSTVPWFVKQCIEAVEKRGLDVDGIYRVSGNLATIQKLRFIVNQEEKLNLDDSQWEDIHVVTGALKMFFRELPEPLFPYSFFEQFVEAIKKQDNNTRIEAVKSLVQKLPPPNRDTMKVLFGHLTKIVAKASKNLMSTQSLGIVFGPTLLRAENETGNMAIHMVYQNQIAELMLSEYSKIFGSEED

SEQ ID NO: 24634 - protein, 56 aa, Homo sapiens
  ENSP00000390310
  MOD_RES (1)..(1): Any amino acid
XLDVDGIYRVSGNLATIQKLRFIVNQVVSGIPALLSELDGDLWTPLVSCRFFTVVI

SEQ ID NO: 24635 - protein, 1191 aa, Homo sapiens
  ENSP00000260283
MEAMSPQQETLGGQPGRSSSLTGVSRLAGGSCTKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 24636 - protein, 731 aa, Homo sapiens
  ENSP00000437905
MDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRNCC

SEQ ID NO: 24637 - protein, 1168 aa, Homo sapiens
  ENSP00000432076
MSARERQPALKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 24638 - protein, 1155 aa, Homo sapiens
  ENSP00000436319
MKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 24639 - protein, 1165 aa, Homo sapiens
  ENSP00000436522
MTFWIIINKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 24640 - protein, 1155 aa, Homo sapiens; identical to SEQ ID NO: 24638
  ENSP00000431399

SEQ ID NO: 24641 - protein, 698 aa, Homo sapiens
  ENSP00000249601
MLSPKIRQARRARSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 24642 - protein, 531 aa, Homo sapiens
  ENSP00000422868
MCVPPHRKDGSIPCPRALCSQSVDIQAWQLSAAQRGDVGQPREFWHLRSQVPVPTCHLLTVQPWCLLPHPTPAGGRERRHSASSLLAALCLRKAVLRPHPAVLPGVGGCVVLSSGRMKAPLRGGLALGTGPAPTKLQLLHDWQSEPGPSGWQQGPSPPLFPAGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 24643 - protein, 539 aa, Homo sapiens
  ENSP00000363285
MGLCCCKDWRGHLRAPKGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDRFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 24644 - protein, 589 aa, Homo sapiens
  ENSP00000363287
MASSQRDMEDWVQAIRRVIWAPLGGGTARRSHAHPLEPLPPGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 24645 - protein, 608 aa, Homo sapiens
  ENSP00000410054
MPFWPIRCLKRSRRMPRGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 24646 - protein, 704 aa, Homo sapiens
  ENSP00000416701
MLPTASSKRRTFAARYFTRSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 24647 - protein, 714 aa, Homo sapiens
  ENSP00000412461
MLSPKIRQARRARSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGTARRSHAHPLEPLPPGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARYEDFLSCAQLLTKDEGEGTLELAKQVSNLPQANYNLLRYICKFLDEVQAYSNVNKMSVQNLATVFGPNILRPQVEDPVTIMEGTSLVQHLMTVLIRKHSQLFTAPVPEGPTSPRGGLQCAVGWGSEEVTRDSQGEPGGPGLPAHRTSSLDGAAVAVLSRTAPTGPGSRCSPGKKVQTLPSWKSSFRQPRSLSGSPKGGGSSLEVPIISSGGNWLMNGLSSLRGHRRASSGDRLKDSGSVQRLSTYDNVPAPGLVPGIPSVASMAWSGASSSESSVGGSLSSCTACRASDSSARSSLHTDWALEPSPLPSSSEDPKSLDLDHSMDEAGAGASNSEPSEPDSPTREHARRSEALQGLVTELRAELCRQRTEYERSVKRIEEGSADLRKRMSRLEEELDQEKKKYIMLEIKLRNSERAREDAERRNQLLQREMEEFFSTLGSLTVGAKGARAPK

SEQ ID NO: 24648 - protein, 261 aa, Homo sapiens
  ENSP00000422663
MLPTASSKRRTFAARYFTRSKSLVMGEQSRSPGRMPCPHRLGPVLKAGWLKKQRSIMKNWQQRWFVLRGDQLFYYKDKDEIKPQGFISLQGTQVTELPPGPEDPGKHLFEISPGGAGEREKVPANPEALLLMASSQRDMEDWVQAIRRVIWAPLGGGIFGQRLEETVHHERKYGPRLAPLLVEQCVDFIRERGLTEEGLFRMPGQANLVRDLQDSFDCGEKPLFDSTTDVHTVASLLKLYLRELPEPVVPFARALWSWLNK

SEQ ID NO: 24649 - protein, 1491 aa, Homo sapiens
  ENSP00000481862
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSDSTTCSSAKSKGSWAPKKEPYAREMLAISFISAVNRKRKKRREARGLGSSTDDDSEQEAHKPGAGATAPGTQERPQGPLPGAVAPEAPGRLSPPAAPEERPAADTRSIVSGYSTLSTMDRSVCSGASGRRAGAGDEADDERSELSHVETDTEGAAGAGPGGRLTRRPSFSSHHLMPCDTLARRRLARGRPDGEGAGRGGPRAPEPPGSASSSSQESLRPPAAALASRPSRMEALRLRLRGTADDMLAVRLRRPLSPETRRRRSSWRRHTVVVQSPLTDLNFNEWKELGGGGPPEPAGARAHSDNKDSGLSSLESTKARAPSSAASQPPAPGDTGSLQSQPPRRSAASRLHQCL

SEQ ID NO: 24650 - protein, 1144 aa, Homo sapiens
  ENSP00000482992
MNGVAFCLVGIPPRPEPRPPQLPLGPRDGCSPRRPFPWQGPRTLLLYKSPQDGFGFTLRHFIVYPPESAVHCSLKEEENGGRGGGPSPRYRLEPMDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYAPPARASTRATMVPEPTSALPSDPRSPAAWSDPGLRVPPAARAHLDNSSLGMSQPRPSPGAFPHLSSEPRTPRAFPEPGSRVPPSRLECQQALSHWLSNQVPRRAGERRCPAMAPRARSASQDRLEEVAAPRPWPCSTSQDALSQLGQEGWHRARSDDYLSRATRSAEALGPGALVSPRFERCGWASQRSSARTPACPTRDLPGPQAPPPSGLQGLDDLGYIGYRSYSPSFQRRTGLLHALSFRDSPFGGLPTFNLAQSPASFPPEASEPPRVVRPEPSTRALEPPAEDRGDEVVLRQKPPTGRKVQLTPARQMNLGFGDESPEPEASGRGERLGRKVAPLATTEDSLASIPFIDEPTSPSIDLQAKHVPASAVVSSAMNSAPVLGTSPSSPTFTFTLGRHYSQDCSSIKAGRRSSYLLAITTERSKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAGEDEAAPVCIGSCLVDISYSETKRRHVFRLTTADFCEYLFQAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRIVEARGLESTGIYRVPGNNAVVSSLQEQLNRGPGDINLQDERWQDLNVISSLLKSFFRKLPEPLFTDDKYNDFIEANRIEDARERMRTLRKLIRDLPGHYYETLKFLVGHLKTIADHSEKNKMEPRNLALVFGPTLVRTSEDNMTDMVTHMPDRYKIVETLIQHSDWFFSDEEDKGERTPVGDKEPQAVPNIEYLLPNIGRTVPPGDPGSADLLEI

SEQ ID NO: 24651 - protein, 102 aa, Homo sapiens
  ENSP00000482982
MDTIFVKNVKEDGPAHRAGLRTGDRLVKVNGESVIGKTYSQVIALIQNSDDTLELSIMPKDEDILQLAYSQDAYLKGNEPYSGEARSIPEPPPICYPRKTYA

SEQ ID NO: 24652 - protein, 129 aa, Homo sapiens
  ENSP00000483748
SKSCDDGLNTFRDEGRVLRRLPNRIPSLRMLRSFFTDGSLDSWGTSEDADAPSKRHSTSDLSDATFSDIRREGWLYYKQILTKKGKKAGSGLRQWKRVYAALRARSLSLSKERREPGPAAAGAAAAGAG

SEQ ID NO: 24653 - protein, 163 aa, Homo sapiens
  ENSP00000481292
  MOD_RES (1)..(1): Any amino acid
XTFSDIRREGWLYYKQILTKKGKAEDRDDMLGWIRAIRENSRAEGEDPGCANQALISKKLNDYRKVSHSSGPKADSSPKGSRGLGGLKSEFLKQSAARGLRTQDLPAGSKDDSAAAPKTPWGINIIKKNKKAAPRAFGVRLEECQPATENQRVPLIVAACCRI

SEQ ID NO: 24654 - protein, 83 aa, Homo sapiens
  ENSP00000482425
RVPLIVAACCRIVEARGLESTGIYRVPGNNAVVSSLQEQLNRGPGDINLQDERWQDLNVISSLLKSFFRKLPEPLFTDGALLF

SEQ ID NO: 24655 - protein, 135 aa, Homo sapiens
  ENSP00000478142
IRDLPGHYYETLKFLVGHLKTIADHSEKNKMEPRNLALVFGPTLVRTSEDNMTDMVTHMPDRYKIVETLIQHSDWFFSDEEDKGERILPPVVQPSPRVRGPPRRSRTPGRCWRSPSSRPSTASARSGGRRGGWAA

SEQ ID NO: 24656 - protein, 64 aa, Homo sapiens
  ENSP00000484509
  MOD_RES (1)..(1): Any amino acid
XFFSDEEDKGERTPVGDKEPQAVPNIEYLLPNIGRTVPPGDPGSDSTTCSSAKSKVRMKAILKA

SEQ ID NO: 24657 - protein, 1491 aa, Homo sapiens; identical to SEQ ID NO: 24649
  ENSP00000479208

SEQ ID NO: 24658 - protein, 1144 aa, Homo sapiens; identical to SEQ ID NO: 24650
  ENSP00000488428

SEQ ID NO: 24659 - protein, 102 aa, Homo sapiens; identical to SEQ ID NO: 24651
  ENSP00000488885

SEQ ID NO: 24660 - protein, 129 aa, Homo sapiens; identical to SEQ ID NO: 24652
  ENSP00000487883

SEQ ID NO: 24661 - protein, 163 aa, Homo sapiens; identical to SEQ ID NO: 24653
  ENSP00000488827
  MOD_RES (1)..(1): Any amino acid

SEQ ID NO: 24662 - protein, 83 aa, Homo sapiens; identical to SEQ ID NO: 24654
  ENSP00000488699

SEQ ID NO: 24663 - protein, 135 aa, Homo sapiens; identical to SEQ ID NO: 24655
  ENSP00000488310

SEQ ID NO: 24664 - protein, 64 aa, Homo sapiens; identical to SEQ ID NO: 24656
  ENSP00000487994
  MOD_RES (1)..(1): Any amino acid

SEQ ID NO: 24665 - protein, 748 aa, Homo sapiens
  ENSP00000378611
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 24666 - protein, 246 aa, Homo sapiens
  ENSP00000423206
MEENNDSTENPQQGQGRQNAIKCGWLRKQGGFVKTWHTRWFVLKGDQLYYFKDEDETKPLGTIFLPGNKVSEHPCNEENPGKFLFEVVPGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAVS

SEQ ID NO: 24667 - protein, 82 aa, Homo sapiens
  ENSP00000426105
MTANHESYLLMASTQNDMEDWVKSIRRVIWGPFGGGIFGQKLEDTVRYEKRYGNRLAPMLVEQCVDFIRQRGLKEEGLFRLP

SEQ ID NO: 24668 - protein, 653 aa, Homo sapiens
  ENSP00000378610
MTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 24669 - protein, 118 aa, Homo sapiens
  ENSP00000424256
MFVQGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEA

SEQ ID NO: 24670 - protein, 622 aa, Homo sapiens
  ENSP00000425589
MFVQGGDRDRMTANHESYLLMASTQNDMEDWVKSIRRVIWGPFGGGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERA

SEQ ID NO: 24671 - protein, 655 aa, Homo sapiens
  ENSP00000264343
MPEDRNSGGCPAGALASTPFIPKTTYRRIKRCFSFRKGIFGQKLEDTVRYEKRYGNRLAPMLVEQCVDFIRQRGLKEEGLFRLPGQANLVKELQDAFDCGEKPSFDSNTDVHTVASLLKLYLRELPEPVIPYAKYEDFLSCAKLLSKEEEAGVKELAKQVKSLPVVNYNLLKYICRFLDEVQSYSGVNKMSVQNLATVFGPNILRPKVEDPLTIMEGTVVVQQLMSVMISKHDCLFPKDAELQSKPQDGVSNNNEIQKKATMGQLQNKENNNTKDSPSRQCSWDKSESPQRSSMNNGSPTALSGSKTNSPKNSVHKLDVSRSPPLMVKKNPAFNKGSGIVTNGSFSSSNAEGLEKTQTTPNGSLQARRSSSLKVSGTKMGTHSVQNGTVRMGILNSDTLGNPTNVRNMSWLPNGYVTLRDNKQKEQAGELGQHNRLSTYDNVHQQFSMMNLDDKQSIDSATWSTSSCEISLPENSNSCRSSTTTCPEQDFFGGNFEDPVLDGPPQDDLSHPRDYESKSDHRSVGGRSSRATSSSDNSETFVGNSSSNHSALHSLVSSLKQEMTKQKIEYESRIKSLEQRNLTLETEMMSLHDELDQERKKFTMIEIKMRNAERAKEDAEKRNDMLQKEMEQFFSTFGELTVEPRRTERGNTIWIQ

SEQ ID NO: 24672 - protein, 283 aa, Homo sapiens
  ENSP00000417283
MTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKNYRNRNDCQSVVSAQIHQFCPRVSLLAHGQAHLLVNDLLV

SEQ ID NO: 24673 - protein, 646 aa, Homo sapiens
  ENSP00000386911
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 24674 - protein, 606 aa, Homo sapiens
  ENSP00000420583
MSLKLPRNWDFNLKVEAAKIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 24675 - protein, 139 aa, Homo sapiens
  ENSP00000420427
MSLKLPRNWDFNLKVEAAKIARSRSVMTGEQMAAFHPSSTPNPLERPIKMGWLKKQRSIVKNWQQRYFVLRAQQLYYYKDEEDTKPQQCLASAWMRLWPMNRNSAPIWCPSWWRNVQSSSWSTAGMKRASSVCLGRTTW

SEQ ID NO: 24676 - protein, 638 aa, Homo sapiens
  ENSP00000386863
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 24677 - protein, 639 aa, Homo sapiens
  ENSP00000386241
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 24678 - protein, 85 aa, Homo sapiens
  ENSP00000417425
MSLGQSACLFLSIARSRSVMTGEQMAAFHPSSTPNPLERPIKMGWLKKQRSIVKNWQQSGPPGSTRTGTVEFPTHGSESRLATGR

SEQ ID NO: 24679 - protein, 458 aa, Homo sapiens
  ENSP00000417139
MSLGQSACLFLSIARSRSVMTGEQMAAFHPSSTPNPLERPIKMGWLKKQRSIVKNWQQRYFVLRAQQLYYYKDEEDTKPQGCMYLPGCTIKEIATNPEEAGKFVFEIIPASWDQNRMGQDSYVLMASSQAEMEEWVKFLRRVAGTPCGAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMVRCREPSCFHWVLPLVQAIPCKACSRVAIWGVLGDAVAVGAAATDSSEHTLKAWPLSKSSFYWHL

SEQ ID NO: 24680 - protein, 505 aa, Homo sapiens
  ENSP00000417818
  MOD_RES (1)..(1): Any amino acid
XAQNDGQVLFALSSAVFGQRLDETVAYEQKFGPHLVPILVEKCAEFILEHGRNEEGIFRLPGQDNLVKQLRDAFDAGERPSFDRDTDVHTVASLLKLYLRDLPEPVVPWSQYEGFLLCGQLTNADEAKAQQELMKQLSILPRDNYSLLSYICRFLHEIQLNCAVNKMSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 24681 - protein, 339 aa, Homo sapiens
  ENSP00000417467
MSVDNLATVIGVNLIRSKVEDPAVIMRGTPQIQRVMTMMIRDHEVLFPKSKDIPLSPPAQKNDPKKAPVARSSVGWDATEDLRISRTDSFSSMTSDSDTTSPTGQQPSDAFPEDSSKVPREKPGDWKMQSRKRTQTLPNRKCFLTSAFQGANSSKMEIFKNEFWSPSSEAKAGEGHRRTMSQDLRQLSDSQRTSTYDNVPSLPGSPGEEASALSSQACDSKGDTLASPNSETGPGKKNSGEEEIDSLQRMVQELRKEIETQKQMYEEQIKNLEKENYDVWAKVVRLNEELEKEKKKSAALEISLRNMERSREDVEKRNKALEEEVKEFVKSMKEPKTEA

SEQ ID NO: 24682 - protein, 814 aa, Homo sapiens
  ENSP00000274498
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNVHPSQEPGWLEGTLNGKTGLIPENYVEFL

SEQ ID NO: 24683 - protein, 759 aa, Homo sapiens
  ENSP00000367243
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVSTPFRKAKALYACKAEHDSELSFTAGTVFDNVHPSQEPGWLEGTLNGKTGLIPENYVEFL

SEQ ID NO: 24684 - protein, 166 aa, Homo sapiens
  ENSP00000367252
MEPLAPSPRIWTCVFYFGIESEEDLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMF

SEQ ID NO: 24685 - protein, 91 aa, Homo sapiens
  ENSP00000411571
MVPFDQKSGGKGGEDESVILKSCTRRKTDSIEKRFCFDVEAVDRPGVITMQALSEEDRRLWMEAMDGREPVYNSNKDSQSEGTAQLDSIGF

SEQ ID NO: 24686 - protein, 388 aa, Homo sapiens
  ENSP00000393276
  MOD_RES (1)..(1): Any amino acid
XAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRPEEAVHEDSSTPFRKAKALYACKAEHDSELSFTAGTVFDNVHPSQEPGWLEGTLNGKTGLIPENYVEFL

SEQ ID NO: 24687 - protein, 294 aa, Homo sapiens
  ENSP00000416889
  MOD_RES (1)..(1): Any amino acid
XPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLTPFRKAKALYACKAEHDSELSFTAGTVFDNVHPSQEPGWLEGTLNGKTGLIPENYVEFL

SEQ ID NO: 24688 - protein, 97 aa, Homo sapiens
  ENSP00000392186
AKLENQESRVSEIHSLVHRLPEKNRQMLQLLMNHLAKYAGGLGKKCVKCSLQWRTAANARWPSQRMLGKCSCNQATKQSFQGDFTYGDQGQIGVCCP

SEQ ID NO: 24689 - protein, 127 aa, Homo sapiens
  ENSP00000413283
IVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLVQPPRQLCSLPSKPALAF

SEQ ID NO: 24690 - protein, 127 aa, Homo sapiens
  ENSP00000400565
VIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLHWGFGMCLEGCTEVQSPAS

SEQ ID NO: 24691 - protein, 154 aa, Homo sapiens
  ENSP00000389137
  MOD_RES (1)..(1): Any amino acid
XPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNAECPSASTAIFTATPKLRAPPPLTWALPLAA

SEQ ID NO: 24692 - protein, 98 aa, Homo sapiens
  ENSP00000403388
  MOD_RES (1)..(1): Any amino acid
XPNPSPTSPLSPSWPMFSAPSSPMPTSSTSSDSSPVSTPFRKAKALYACKAEHDSELSFTAGTVFDNAECPSASTAIFTATPKLRAPPPLTWALPLAA

SEQ ID NO: 24693 - protein, 1035 aa, Homo sapiens
  ENSP00000449764
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPETLIQNYRVLHLQYVFCC

SEQ ID NO: 24694 - protein, 1261 aa, Homo sapiens
  ENSP00000260526
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEGEIPQFV

SEQ ID NO: 24695 - protein, 393 aa, Homo sapiens
  ENSP00000359237
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVTIFFFFICKLN

SEQ ID NO: 24696 - protein, 2087 aa, Homo sapiens
  ENSP00000310561
METESESSTLGDDSVFWLESEVIIQVTDCEEEEREEKFRKMKSSVHSEEDDFVPELHRNVHPRERPDWEETLSAMARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 24697 - protein, 1738 aa, Homo sapiens
  ENSP00000376425
MKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGAVTHDPPQDSVPVSSVSLIPPPPPPKNVARMLALALAESAQQASTQSLKRPGTSQAGYTNYGDIAVATTEDNLSSSYSAVALDKAYFQTDRPAEQFHLQNNAPGNCDHPLPETTATGDPTHSNTTESGEQHHQVDLTGNQPHQAYLSGDPEKARITSVPLDSEKSDDHVSFPEDQSGKNSMPTVSFLDQDQSPPRFYSGDQPPSYLGASVDKLHHPLEFADKSPTPPNLPSDKIYPPSGSPEENTSTATMTYMTTTPATAQMSTKEASWDVAEQPTTADFAAATLQRTHRTNRPLPPPPSQRSAEQPPVVGQVQAATNIGLNNSHKVQGVVPVPERPPEPRAMDDPASAFISDSGAAAAQCPMATAVQPGLPEKVRDGARVPLLHLRAESVPAHPCGFPAPLPPTRMMESKMIAAIHSSSADATSSSNYHSFVTASSTSVDDALPLPLPVPQPKHASQKTVYSSFARPDVTTEPFGPDNCLHFNMTPNCQYRPQSVPPHHNKLEQHQVYGARSEPPASMGLRYNTYVAPGRNASGHHSKPCSRVEYVSSLSSSVRNTCYPEDIPPYPTIRRVQSLHAPPSSMIRSVPISRTEVPPDDEPAYCPRPLYQYKPYQSSQARSDYHVTQLQPYFENGRVHYRYSPYSSSSSSYYSPDGALCDVDAYGTVQLRPLHRLPNRDFAFYNPRLQGKSLYSYAGLAPRPRANVTGYFSPNDHNVVSMPPAADVKHTYTSWDLEDMEKYRMQSIRRESRARQKVKGPVMSQYDNMTPAVQDDLGGIYVIHLRSKSDPGKTGLLSVAEGKESRHAAKAISPEGEDRFYRRHPEAEMDRAHHHGGHGSTQPEKPSLPQKQSSLRSRKLPDMGCSLPEHRAHQEASHRQFCESKNGPPYPQGAGQLDYGSKGIPDTSEPVSYHNSGVKYAASGQESLRLNHKEVRLSKEMERPWVRQPSAPEKHSRDCYKEEEHLTQSIVPPPKPERSHSLKLHHTQNVERDPSVLYQYQPHGKRQSSVTVVSQYDNLEDYHSLPQHQRGVFGGGGMGTYVPPGFPHPQSRTYATALGQGAFLPAELSLQHPETQIHAE

SEQ ID NO: 24698 - protein, 946 aa, Homo sapiens
  ENSP00000432468
MARGADVPEIPGDLTLKTCGSTASMKVKHVKKLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTLKDSPESVTQMLMAYLSRLSAIAGNKINCGPALTWMEIDNKGNHLLVHEESSINTPAVGAAHVIKRYTARAPDELTLEVGDIVSVIDMPPKVLSTWWRGKHGFQVGLFPGHCVELINQKVPQSVTNSVPKPVSKKHGKLITFLRTFMKSRPTKQKLKQRGILKERVFGCDLGEHLLNSGFEVPQVLQSCTAFIERYGIVDGIYRLSGVASNIQRLRHEFDSEHVPDLTKEPYVQDIHSVGSLCKLYFRELPNPLLTYQLYEKFSDAVSAATDEERLIKIHDVIQQLPPPHYRTLEFLMRHLSLLADYCSITNMHAKNLAIVWAPNLLRSKQIESACFSGTAAFMEVRIQSVVVEFILNHVDVLFSGRISMAMQEGAASLSRPKSLLVSSPSTKLLTLEEAQARTQAQVNSPIVTENKYIEVGEGPAALQGKFHTIIEFPLERKRPQNKMKKSPVGSWRSFFNLGKSSSVSKRKLQRNESEPSEMKAMALKGGRAEGTLRSAKSEESLTSLHAVDGDSKLFRPRRPRSSSDALSASFNGEMLGNRCNSYDNLPHDNESEEEGGLLHIPALMSPHSAEDVDLSPPDIGVASLDFDPMSFQCSPPKAESECLESGASFLDSPGYSKDKPSANKKDAETGSSQCQTPGSTASSEPVSPLQEKLSPFFTLDLSPTEDKSSKPSSFTEKVVYAFSPKIGRKLSKSPSMSISEPISVTLPPRVSEVIGTVSNTTAQNASSSTWDKCVEERDATNRSPTQIVKMKTNETVAQEAYESEVQPLDQVAAEEVELPGKEDQSVSSSQSKAVASGQTQTGTVCFPPFFL

SEQ ID NO: 24699 - protein, 1738 aa, Homo sapiens; identical to SEQ ID NO: 24697
  ENSP00000432862

SEQ ID NO: 24700 - protein, 178 aa, Homo sapiens
  ENSP00000432303
MKSSVHSEEDDFVPELHRNVHPRERPDWEETLSAMARGADVPEIPGDLTLKTCGSTASMKVKHVKKSTTPGLMGCDNIHRLPFTKGHFPKMAECAHFHYENVEFGSIQLSLSEEQNEVMKNGCESKELVYLVQIACQGKSWIVKRSYEDFRVLDKHLHLCIYDRRFSQLSELPRSDTL

SEQ ID NO: 24701 - protein, 1279 aa, Homo sapiens
  ENSP00000355060
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 24702 - protein, 1240 aa, Homo sapiens
  ENSP00000364564
MASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 24703 - protein, 1052 aa, Homo sapiens
  ENSP00000364557
MLPSSSWGKRKLRGRLGWVRSDARGVMWARQEGLHHPHPHAVIRCPSSSSSSVSCSGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPGQKHLCVTSLLICQGLLWVGTDQGVIVLLPVPRLEGIPKITGKGMVSLNGHCGPVAFLAVATSILAPDILRSDQEEAEGPRAEEDKPDGQAHEPMPDSHVGRELTRKKGILLQYRLRSTAHLPGPLLSMREPAPADGAALEHSEEDGSIYEMADDPDIWVRSRPCARDAHRKEICSVAIISGGQGYRNFGSALGSSGRQAPCGETDSTLLIWQVPLML

SEQ ID NO: 24704 - protein, 611 aa, Homo sapiens
  ENSP00000167825
KPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLREENQPGWLCPDEDKKSKAPFWCPILACCIPAFSSRALSLQLGALVHSPVNCPLLGFSAVSTSLPQGYLWVGGGQEGAGGQVEIFSLNRPSPRTVKSFPLAAPVLCMEYIPELEEEAESRDESPTVADPSATVHPTICLGLQDGSILLYSSVDTGTQCLVSCRSPGLQPVLCLRHSPFHLLAGLQDGTLAAYPRTSGGVLWDLESPPVCLTVGPGPVRTLLSLEDAVWASCGPRVTVLEATTLQPQQSFEAHQDEAVSVTHMVKAGSGVWMAFSSGTSIRLFHTETLEHLQEINIATRTTFLLPDRSLIKCSPRA

SEQ ID NO: 24705 - protein, 958 aa, Homo sapiens
  ENSP00000315325
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 24706 - protein, 986 aa, Homo sapiens
  ENSP00000354837
MSRIESLTRARIDRSRELASKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 24707 - protein, 1031 aa, Homo sapiens
  ENSP00000476916
MLSKSVPVSGINCLLDRSDTDGNVSQSSAIDLRKRCSQLEGHSGTRVGSSLRQTFSFLSGMTGKAKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 24708 - protein, 263 aa, Homo sapiens
  ENSP00000476689
  MOD_RES (1)..(1): Any amino acid
XQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRGETLAETWTRDFTRMQDIPEETESRDGEAVASES

SEQ ID NO: 24709 - protein, 985 aa, Homo sapiens
  ENSP00000314787
MSRIESLTRARIDRSRELASKTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEEVIYSELMSDFEMDEKDFAADSWSLAVDSSFLQQHKKEVMKQQDVIYELIQTELHHVRTLKIMTRLFRTGMLEELHLEPGVVQGLFPCVDELSDIHTRFLSQLLERRRQALCPGSTRNFVIHRLGDLLISQFSGPSAEQMCKTYSEFCSRHSKALKLYKELYARDKRFQQFIRKVTRPAVLKRHGVQECILLVTQRITKYPLLISRILQHSHGIEEERQDLTTALGLVKELLSNVDEGIYQLEKGARLQEIYNRMDPRAQTPVPGKGPFGREELLRRKLIHDGCLLWKTATGRFKDVLVLLMTDVLVFLQEKDQKYIFPTLDKPSVVSLQNLIVRDIANQEKGMFLISAAPPEMYEVHTASRDDRSTWIRVIQQSVRTCPSREDFPLIETEDEAYLRRIKMELQQKDRALVELLREKVGLFAEMTHFQAEEDGGSGMALPTLPRGLFRSESLESPRGERLLQDAIREVEGLKDLLVGPGVELLLTPREPALPLEPDSGGNTSPGVTANGEARTFNGSIELCRADSDSSQRDRNGNQLRSPQEEALQRLVNLYGLLHGLQAAVAQQDTLMEARFPEGPERREKLCRANSRDGEAGRAGAAPVAPEKQATELALLQRQHALLQEELRRCRRLGEERATEAGSLEARLRESEQARALLEREAEEARRQLAALGQTEPLPAEAPWARRPVDPRRRSLPAGDALYLSFNPPQPSRGTDRLDLPVTTRSVHRNFEDRERQELGSPEERLQDSSDPDTGSEEEGSSRLSPPHSPRDFTRMQDIPEETESRDGEAVASES

SEQ ID NO: 24710 - protein, 59 aa, Homo sapiens
  ENSP00000477448
QQKAALLKNNTALQSVSLRSKNISMMSLPWGCAGSSHSPQTPSTCGTEPYPWNPSLTKR

SEQ ID NO: 24711 - protein, 229 aa, Homo sapiens
  ENSP00000477299
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIYELIQTELHHVRTLKI

SEQ ID NO: 24712 - protein, 214 aa, Homo sapiens
  ENSP00000476724
MKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLSVESLIDEAEVIYSELMSDFEMDEKDFAADSWSLAVDSSFLQQHKKEVMKQQDVIY

SEQ ID NO: 24713 - protein, 178 aa, Homo sapiens
  ENSP00000476699
MSGNRRQPSRRGQTREKEKMKEAKDARYTNGHLFTTISVSGMTMCYACNKSITAKEALICPTCNVTIHNRCKDTLANCTKVKQKQQKAALLKNNTALQSVSLRSKTTIRERPSSAIYPSDSFRQSLLGSRRGRSSLSLAKSVSTTNIAGHFNDESPLGLRRILSQSTDSLNMRNRTLS

SEQ ID NO: 24714 - protein, 83 aa, Homo sapiens
  ENSP00000476532
MLSKSVPVSGINCLLDRSDTDGNVSQSSAIDLRKRCSQLEGHSGTRVGSSLRQTFSFLSGMTGKAKTREKEKMKEAKDARYTN

SEQ ID NO: 24715 - protein, 7 aa, Homo sapiens
  ENSP00000476518
MLSKSVP

SEQ ID NO: 24716 - protein, 264 aa, Homo sapiens [sequence omitted]

SEQ ID NO: 24717 - protein, 871 aa, Homo sapiens
  ENSP00000348828
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTSLTQVEIVRSFTAKQPDELSLQVADVVLIYQRVSDGWYEGERLRDGERGWFPMECAKEITCQATIDKNVERMGRLLGLETNV

SEQ ID NO: 24718 - protein, 871 aa, Homo sapiens; identical to SEQ ID NO: 24717
  ENSP00000423418

SEQ ID NO: 24719 - protein, 791 aa, Homo sapiens
  ENSP00000424446
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKGLSQTVSQEERKRQEAIFEVISSEHSYLLSLEILIRMFKNSKELSDTMTKTERHHLFSNITDVCEASKKFFIELEARHQNNIFIDDISDIVEKHTASTFDPYVKYCTNEVYQQRTLQKLLATNPSFKEVLSRIESHEDCRNLPMISFLILPMQRVTRLPLLMDTICQKTPKDSPKYEVCKRALKEVSKLVRLCNEGARKMERTEMMYTINSQLEFKIKPFPLVSSSRWLVKRGELTAYVEDTVLFSRRTSKQQVYFFLFNDVLIITKKKSEESYNVNDYSLRDQLLVESCDNEELNSSPGKNSSTMLYSRQSSASHLFTLTVLSNHANEKVEMLLGAETQSERARWITALGHSSGKPPADRTCG

SEQ ID NO: 24720 - protein, 446 aa, Homo sapiens
  ENSP00000423295
MDGESEVDFSSNSITPLWRRRSIPQPHQVLGRSKPRPQSYQSPNGLLITDFPVEDGGTLLAAQIPAQVPTASDSRTVHRSPLLLGAQRRAVANGGTASPEYRAASPRLRRPKSPKLPKAVPGGSPKSPANGAVTLPAPPPPPVLRPPRTPNAPAPCTPEEDLTGLTASPVPSPTANGLAANNDSPGSGSQSGRKAKDPERGLFPGPQKSSSEQKLPLQRLPSQENELLENPSVVLSTNSPAALKVGKQQIIPKSLASEIKISKSNNQNVEPHKRLLKVRSMVEGLGGPLGHAGEESEVDNDVDSPGSLRRGLRSTSYRRAVVSGFDFDSPTSSKKKNRMSQPVLKVVMEDKEKFSSLGRIKKKMLKGQGTFDGEENAVLYQNYKEKALDIDSDEESEPKEQKSDEKIVIHHKPLRSTWSQLSAVKRKVILIVGFMEMKDGRLRGGK

SEQ ID NO: 24721 - protein, 446 aa, Homo sapiens; identical to SEQ ID NO: 24720
  ENSP00000486665

SEQ ID NO: 24722 - protein, 791 aa, Homo sapiens; identical to SEQ ID NO: 24719
  ENSP00000487265

SEQ ID NO: 24723 - protein, 871 aa, Homo sapiens; identical to SEQ ID NO: 24717
  ENSP00000481927

SEQ ID NO: 24724 - protein, 871 aa, Homo sapiens; identical to SEQ ID NO: 24717
  ENSP00000484367

SEQ ID NO: 24725 - protein, 1651 aa, Homo sapiens
  ENSP00000296794
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGN

SEQ ID NO: 24726 - protein, 83 aa, Homo sapiens
  ENSP00000421859
MELSCSEAPLYGQMMIYAKFDKNVYLPEDAEFYFTYDGSHQRHVMIAERIEDNVLQSSVPGHGLQETVTVSVCLCSEGYSPVT

SEQ ID NO: 24727 - protein, 1731 aa, Homo sapiens
  ENSP00000411459
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 24728 - protein, 1705 aa, Homo sapiens
  ENSP00000412175
MELSCSEAPLYGQMMIYAKFDKNVYLPEDAEFYFTYDGSHQRHVMIAERIEDNVLQSSVPGHGLQETVTVSVCLCSEGYSPVTMGSGSVTYVDNMACRLARLLVTQANRLTACSHQTLLTPFALTAGALPALDEELVLALTHLELPLEWTVLGSSSLEVSSHRESLLHLAMRWGLAKLSQFFLCLPGGVQALALPNEEGATPLDLALREGHSKLVEDVTNFQGRWSPSFSRVQLSEEASLHYIHSSETLTLTLNHTAEHLLEADIKLFRKYFWDRAFLVKAFEPEARPEERTAMPSSGAETEEEIKNSVSSRSAAEKEDIKRVKSLVVQHNEHEDQHSLDLDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNDLDTSHTESPTPHDSNSHRPQLQAFITEAKLNLPTRTMTRQDGETGDGAKENIVYL

SEQ ID NO: 24729 - protein, 1392 aa, Homo sapiens
  ENSP00000296799
MDSDSDSPFNYSWPSFPKMKIRRRTSKQDRSFDILKKSKPPSTLLAAGRLSDMLNGGDEVYANCMVIDQVGDLDISYINIEGITATTSPESRGCTLWPQSSKHTLPTETSPSVYPLSENVEGTAHTEAQQSFMSPSSSCASNLNLSFGWHGFEKEQSHLKKRSSSLDALDADSEGEGHSEPSHICYTPGSQSSSRTGIPSGDELDSFETNTEPDFNISRAESLPLSSNLQSKESLLSGVRSRSYSCSSPKISLGKTRLVRELTVCSSSEEQRAYSLSEPPRENRIQEEEWDKYIIPAKSESEKYKVSRTFSFLMNRMTSPRNKSKTKSKDAKDKEKLNRHQFAPGTFSGVLQCLVCDKTLLGKESLQCSNCNANVHKGCKDAAPACTKKFQEKYNKNKPQTILGNSSFRDIPQPGLSLHPSSSVPVGLPTGRRETVGQVHPLSRSVPGTTLESFRRSATSLESESDHNSCRSRSHSDELLQSMGSSPSTESFIMEDVVDSSLWSDLSSDAQEFEAESWSLVVDPSFCNRQEKDVIKRQDVIFELMQTEMHHIQTLFIMSEIFRKGMKEELQLDHSTVDKIFPCLDELLEIHRHFFYSMKERRQESCAGSDRNFVIDRIGDILVQQFSEENASKMKKIYGEFCCHHKEAVNLFKELQQNKKFQNFIKLRNSNLLARRRGIPECILLVTQRITKYPVLVERILQYTKERTEEHKDLRKALCLIKDMIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEAESLQVAVKASQMGAVSQSCEDSCGDSVLADTLSSHDVPGSPTASLVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNDLDTSHTESPTPHDSNSHRPQLQAFITEAKLNLPTRTMTRQDGETGDGAKENIVYL

SEQ ID NO: 24730 - protein, 651 aa, Homo sapiens
  ENSP00000421081
MIATVDLKVNEYEKNQKWLEILNKIENKTYTKLKNGHVFRKQALMSEERTLLYDGLVYWKTATGRFKDILALLLTDVLLFLQEKDQKYIFAAVDQKPSVISLQKLIAREVANEERGMFLISASSAGPEMYEIHTNSKEERNNWMRRIQQAVESCPEEKGGRTSESDEDKRKAEARVAKIQQCQEILTNQDQQICAYLEEKLHIYAELGELSGFEDVHLEPHLLIKPDPGEPPQAASLLAAALKEALVTGGREGRGCSDVDPGIQGVVTDLAVSDAGEKVECRNFPGSSQSEIIQAIQNLTRLLYSLQAALTIQDSHIEIHRLVLQQQEGLSLGHSILRGGPLQDQKSRDADRQHEELANVHQLQHQLQQEQRRWLRRCEQQQRAQATRESWLQERERECQSQEELLLRSRGELDLQLQEYQHSLERLREGQRLVEREQARMRAQQSLLGHWKHGRQRSLPAVLLPGGPEVMELNRSESLCHENSFFINEALVQMSFNTFNKLNPSVIHQDATYPTTQSHSDLVRTSEHQVDLKVDPSQPSNVSHKLWTAAGSGHQILPFHESSKDSCKNGSSMTKCSCTLTSPPGLWTGTTSTLKDLDTSHTESPTPHDSNSHRPQLQAFITEAKLNLPTRTMTRQDGETGDGAKENIVYL

SEQ ID NO: 24731 - protein, 1731 aa, Homo sapiens; identical to SEQ ID NO: 24727
  ENSP00000441913

SEQ ID NO: 24732 - protein, 1705 aa, Homo sapiens; identical to SEQ ID NO: 24728
  ENSP00000441436

SEQ ID NO: 24733 - protein, 526 aa, Homo sapiens
  ENSP00000296315
MVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 24734 - protein, 558 aa, Homo sapiens
  ENSP00000341071
MDSSTAMNQCSCRGMEENKERPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 24735 - protein, 532 aa, Homo sapiens
  ENSP00000410922
MIEVCHHNWLLWLCPSKFGIFMCCLASTTGQMELRRTREPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 24736 - protein, 236 aa, Homo sapiens
  ENSP00000417810
  MOD_RES (1)..(1): Any amino acid
XVESCPARSRLSVSVSPPPPGIVELGPPFAWEFCSRLGSAVTSQRAGPAAAMVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEAPLPQLL

SEQ ID NO: 24737 - protein, 532 aa, Homo sapiens
  ENSP00000420420
MRSERPMVWCCLFVRSQRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 24738 - protein, 497 aa, Homo sapiens
  ENSP00000418826
MIEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 24739 - protein, 416 aa, Homo sapiens
  ENSP00000417986
MVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERSMDSSRG

SEQ ID NO: 24740 - protein, 184 aa, Homo sapiens
  ENSP00000417087
MFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQ

SEQ ID NO: 24741 - protein, 196 aa, Homo sapiens
  ENSP00000420402
MFDRNIWPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHE

SEQ ID NO: 24742 - protein, 50 aa, Homo sapiens
  ENSP00000418984
MDSSTAMNQCSCRGMEENKERAVGGVSGTSAINGRNNWFFRLLRKSDLCG

SEQ ID NO: 24743 - protein, 100 aa, Homo sapiens
  ENSP00000418469
MDSSTAMNQCSCRGMEENKERPKRQRQNNFPMFPSPKAWNFRGRKRKQSTQDEDAVSLCSLDISEPSNKRVKPLSRVTSLANLIPPVKATPLKRFSQTLQ

SEQ ID NO: 24744 - protein, 70 aa, Homo sapiens
  ENSP00000420633
MFDRNICPVILHVKRTNSVLALRLVHSLNGSGKTTFPCFPLLKPGISEGSSRDHPRRKQLILTSLLQDLL

SEQ ID NO: 24745 - protein, 870 aa, Homo sapiens
  ENSP00000387020
MEKTKTKQGENEHMPVNNPSTQIYQLQALASELKTGFTEAMQELSRIQHGEYALEEKVKSCRCSMEEKVTEMKNSLNYFKEELSNAMSMIQAITSKQEEMQQKIEQLQQEKRRESRKVKAKKTQKEEHSSQAGPAQAQGSPFRSINIPEPVLPSEDFTNLLPSQAYEKAQESRSVHVGDSNVKGMMGPGVNPTTPEAEENLKSCLSADIQSKGHLPSGMWRQPKDGKEWGEEYVTKDHPDKLKEAGQGRHSSLENVLCETSLAAKRQTVALELLESERKYVINISLILKIKATFQGSDGKRNSKERSLFPGSLRYLVQQHLDLLHALQERVLKWPRQGVLGDLFLKLTNDENNFLDYYVAYLRDLPECISLVHVVVLKEGDEEIKSDIYTLFFHIVQRIPEYLIHLQNVLKFTEQEHPDYYLLLVCVQRLRVFISHYTLLFQCNEDLLIQKRKKLKKSSMAKLYKGLASQCANAGQDASPTAGPEAVRDTGIHSEELLQPYPSAPSSGPAITHLMPPVKKSQQQQSLMESMQPGKPSDWELEGRKHERPESLLAPTQFCAAEQDVKALAGPLQAIPEMDFESSPAEPLGNVERSLRAPAELLPDARGFVPAAYEEFEYGGEIFALPAPYDEEPFQAPALFENCSPASSESSLDICFLRPVSFAMEAERPEHPLQPLPKSATSPAGSSSAYKLEAAAQAHGKAKPLSRSLKEFPRAPPADGVAPRLYSTRSSSGGRAPIKAERAAQAHGPAAAAVAARGASRTFFPQQRSQSEKQTYLEVRREMHLEDTTRFCPKEERESEQTSFSDQNPRQDQKGGFRSSFRKLFKKKSSGSEYREKTNENPSMDPSPTKQDFFRNRLALANDLDQGTAV

SEQ ID NO: 24746 - protein, 109 aa, Homo sapiens
  ENSP00000399688
  MOD_RES (1)..(1): Any amino acid
XGRAPIKAERAAQAHGPAAAAVAARGASRTFFPQQRSQSEKQTYLEEMHLEDTTRFCPKEERESEQTSFSDQNPRQDQKGGFRSSFRKLFKKKNGNATGEDFCGPWGWW

SEQ ID NO: 24747 - protein, 108 aa, Homo sapiens
  ENSP00000413620
GRAPIKAERAAQAHGPAAAAVAARGASRTFFPQQRSQSEKQTYLEEMHLEDTTRFCPKEERESEQTSFSDQNPRQDQKGGFRSSFRKLFKKKNGNATGEDFCGPWGWW

SEQ ID NO: 24748 - protein, 870 aa, Homo sapiens; identical to SEQ ID NO: 24745
  ENSP00000381780

SEQ ID NO: 24749 - protein, 103 aa, Homo sapiens
  ENSP00000425621
MAKHGADEPSSRSGSPDREGRASEDRSLLHQRLAVRELIDTEVSYLHMLQLCASDIRSRLQQLPQGDLDVLFSNIDDIIKVNSRFLHDLQETASKEEEQVQLV

SEQ ID NO: 24750 - protein, 675 aa, Homo sapiens
  ENSP00000328083
MAKHGADEPSSRSGSPDREGRASEDRSLLHQRLAVRELIDTEVSYLHMLQLCASDIRSRLQQLPQGDLDVLFSNIDDIIKVNSRFLHDLQETASKEEEQVQLVGNIFLEFQEELEQVYKVYCASYDQALLLVDTYRKEPELQRHIQGIVEAVVPQAGSSGLSFLLVIPLQRITRYPLLLQKILENTVPDASAYPVLQRAVSALQDVNTNINEYKMRKEVASKYTKVEQLTLRERLARINTHTLSKKTTRLSQLLKQEAGLIPRTEDKEFDDLEERFQWVSLCVTELKNNVAAYLDNLQAFLYFRPHEYNLDIPEGPAVQYCNLARDLHLEAFLKFKQRLEGLVWQPLCSLAKALLGPQNLIKKRLDKLLDFERVEEKLLEVGSVTYQEEAARHTYQALNSLLVAELPQFNQLVMQWLGQIMCTFVTLQRDLAKQVLQRAEGSMAQLPHHHVPEPAFRKLVEDALGRTSNQLRSFQETFEKVQPPPTTQPLLPGSERQVQALLSRYGPGKLYQVTSNISGTGTLDLTLPRGQIVAILQNKDTKGNSGRWLVDTGGHRGYVPAGKLQLYHVVPSAEELRRQAGLNKDPRCLTPEPSPALVPSIPTMNQVIAAYPFVARSSHEVSLQAGQPVTILEAQDKKGNPEWSLVEVNGQRGYVPSGFLARARSPVLWGWSLPS

SEQ ID NO: 24751 - protein, 1816 aa, Homo sapiens
  ENSP00000386794
MLSVVHFLRSFFKTPEPGAHLPGEGEIEDNQLPTSPAEQVEQGWNQQTDRDDSETLSQQSESGSDTKTDPFESASDTESLSGYLPRGVFHPLRGTPVDIEAPWEYPDVSATGPPQEQHLTSVPGLHAKEELDLSPSLEDDSCKNGWRAFATVAGEQEAGHLWDCATSLERESLLAGVPRHTGCCLQRATDSSGPEPVQGVAVQDLRGLSSVSLQKSRSESYLGIPVVWPFLLWCCELGRSWPHIHNRARALVLPSRGPLDNTAPLGTRTKKESTLGPAGDTELLWSQPHSDVPCQPPLRTSCLLRTNRHHSAPETTGDKNRASPRLNCGHMRALVRAHSIAGFSPECPEDPVGQNVVKSGTHVKEGAKNERDPRIQNIPSPAPTQLSGPIPAFQSGAPHLQGPCKPGGFRLQRASQDTPSAGLLGENQLRQDSRSCLVASCLTSELVKLSAEEVPEPAECKSEQSPESRTQEPQGTQLAPRAADERETQKHLWGISVQAGNQTSNYTSKYVLSEESKSPTRAKFPRQPSSEGTQVWSGDLMGCLEVSDSSDAPETTQKSSAIDTSKAAEEAMVLDPNYREQALQGLSEFKAATVSHCGPGAEEGEQGPGGAGGRQLEPKAGGEASRGRGALIIVAVEQKGLQASRSNAGPVPETLPRDFPKERPESPLSTGETPCESPTRGKTPAGNECELPAAPIQGAGDGALQRVAQAAELGRVLVPQAASEETPSTEEPPGERLRGESRSSGSGERGPEEAPEGGAAAARGQRPRVPALEPPQPPRGLRKGAQEPGKRPTFSKVTSFRKGRPLATESPGGVPAPTTEGRRWGSSGPEGLPRENPPAAAGRDAPPLHHGDASAWPEFVPQAAGDRTAGPAGAGHTGTSGDLGSRGPSSESCNAKRLKTTEKKLRARLALAHKTFSNFIESIVLEKENTHERSPSSPKGEKEKSRLRQGSWRAFLKSKDAGSPKKPTLVSLPLGPEVLSPAETDSHCEERAEDKEGYVFSDHWAPPLASTPLSSSLVSPEHRRKSEPTIKCTATQEGGRYLPSGIFPEKSWLASPGSPRAQQAGIAHTLPSSSACCLAYENPGTPCRPTSPKPLSPRPSAQRMGLHYPGRGSAISMVSLGSYSYVDSSSGDPERPKIPKGQTSFLLSLQTLNQDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 24752 - protein, 142 aa, Homo sapiens
  ENSP00000490717
  MOD_RES (1)..(1): Any amino acid
XKKLRARLALAHKTFSNFIESIVLEKENTHERSPSSPKGEKEKSRLRQGSWRAFLKSKDAGSPKKPTLVSLPLGPEVLSPAETDSHCEERAEDKEGYVFSDHWAPPLASTPLSSSLVSPEHRRKSEPTIKCTATQEGDAKPR

SEQ ID NO: 24753 - protein, 372 aa, Homo sapiens
  ENSP00000389661
PLASTPLSSSLVSPEHRRKSEPTIKCTATQEGGRYLPSGIFPEKSWLASPGSPRAQQAGIAHTLPSSSACCLAYENPGTPCRPTSPKPLSPRPSAQRMGLHYPGRGSAISMVSLGSYSYVDSSSGDPERPKIPKGQTSFLLSLQTLNQDEQKEESREGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAVGRPCYLTRQKHPALPSNRPQQQVLVLAEPRRKPSTFWHSISRLAPFRK

SEQ ID NO: 24754 - protein, 695 aa, Homo sapiens
  ENSP00000376680
  MOD_RES (1)..(1): Any amino acid
XEGGQGPRGLGTVPWLRDLPGSENHMPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 24755 - protein, 517 aa, Homo sapiens
  ENSP00000387285
MRGAVSRSWSLESLRSATAAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPK

SEQ ID NO: 24756 - protein, 619 aa, Homo sapiens
  ENSP00000348017
MRPDGQQALDAVVRSFDCHSEAALRQRNDVIYCSLPRTAQGIVQREDQLEVLVSLREVWGRRRGRDGTCTGAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 24757 - protein, 287 aa, Homo sapiens
  ENSP00000432301
  MOD_RES (1)..(1): Any amino acid
XACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 24758 - protein, 690 aa, Homo sapiens
  ENSP00000316845
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 24759 - protein, 670 aa, Homo sapiens
  ENSP00000432267
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEGYVRQCRKRADMFSEEQLRTIFGNIEDIYRCQKAFVKALEQRFNRERPHLSELGACFLEHQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKGRRTAAPPPRLPGPYPADIIPFSEPQSQAS

SEQ ID NO: 24760 - protein, 630 aa, Homo sapiens
  ENSP00000483548
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAMPDGALDTAVCADEVGSEEDLYDDLHSSSHHYSHPGGGGEQLAINELISDGSVVCAEALWDHVTMDDQELGFKAGDVIEVMDATNREWWWGRVADGEGWFPASFVRLRVNQDEPADDDAPLAGNSGAEDGGAEAQSSKDQMRTNVINEILSTERDYIKHLRDICEQADFQIYSEYCNNHPNACVELSRLTKLSKYVYFFEACRLLQKMIDISLDGFLLTPVQKICKYPLQLAELLKYTHPQHRDFKDVEAALHAMKNVAQLINERKRRLENIDKIAQWQSSIEDWEGEDLLVRSSELIYSGELTRVTQPQAKSQQRMFFLFDHQLIYCKKDLLRRDVLYYKGRLDMDGLEVVDLEDGKDRDLHVSIKNAFRLHRGATGDSHLLCTRKPEQKQRWLKAFAREREQVQLDQETGFSITELQRKQAMLNASKQQVTGKPKAVGRPCYLTRQKHPALPSNRPQQQVLVLAEPRRKPSTFWHSISRLAPFRK

SEQ ID NO: 24761 - protein, 192 aa, Homo sapiens
  ENSP00000398455
MPWEEPAGEKPSCSHSQKAFHMEPAQKPCFTTDMVTWALLCISAETVRGEAPSQPRGIPHRSPVSVDDLWLEKTQRKKLQKQAHVERRLHIGAVHKDGVKCWRKTIITSPESLNLPRRSHPLSQSAPTGLNHMGWPEHTPGTAVGRPCYLTRQKHPALPSNRPQQQVLVLAEPRRKPSTFWHSISRLAPFRK

SEQ ID NO: 24762 - protein, 622 aa, Homo sapiens
  ENSP00000359654
MTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 24763 - protein, 622 aa, Homo sapiens; identical to SEQ ID NO: 24762
  ENSP00000359656

SEQ ID NO: 24764 - protein, 776 aa, Homo sapiens
  ENSP00000250617
MNPEEQIVTWLISLGVLESPKKTICDPEEFLKSSLKNGVVLCKLINRLMPGSVEKFCLDPQTEADCINNINDFLKGCATLQVEIFDPDDLYSGVNFSKVLSTLLAVNKATEDQLSERPCGRSSSLSAANTSQTNPQGAVSSTVSGLQRQSKTVEMTENGSHQLIVKARFNFKQTNEDELSVCKGDIIYVTRVEEGGWWEGTLNGRTGWFPSNYVREIKSSERPLSPKAVKGFETAPLTKNYYTVVLQNILDTEKEYAKELQSLLVTYLRPLQSNNNLSTVEVTSLLGNFEEVCTFQQTLCQALEECSKFPENQHKVGGCLLSLMPHFKSMYLAYCANHPSAVNVLTQHSDELEQFMENQGASSPGILILTTNLSKPFMRLEKYVTLLQELERHMEDTHPDHQDILKAIVAFKTLMGQCQDLRKRKQLELQILSEPIQAWEGEDIKNLGNVIFMSQVMVQYGACEEKEERYLMLFSNVLIMLSASPRMSGFIYQGKIPIAGTVVTRLDEIEGNDCTFEITGNTVERIVVHCNNNQDFQEWLEQLNRLIRGPASCSSLSKTSSSSCSAHSSFSSTGQPRGPLEPPQIIKPWSLSCLRPAPPLRPSAALGYKERMSYILKESSKSPKTMKKFLHKRKTERKPSEEEYVIRKSTAALEEDAQILKVIEAYCTSANFQQGHGSSTRKDSIPQVLLPEEEKLIIEETRSNGQTIMEEKSLVDTVYALKDEVRELKQENKRMKQCLEEELKSRRDLEKLVRRLLKQTDECIRGESSSKTSILP

SEQ ID NO: 24765 - protein, 557 aa, Homo sapiens
  ENSP00000369217
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 24766 - protein, 167 aa, Homo sapiens
  ENSP00000456746
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMESISLALNVDISFVCSAGVNI

SEQ ID NO: 24767 - protein, 204 aa, Homo sapiens
  ENSP00000454774
  MOD_RES (1)..(1): Any amino acid
XSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERRLITDSKVKLKYQHLITNSFVECNRLLKWCPAPDCHHVVKVQYPDAKPVRCKCGRQF

SEQ ID NO: 24768 - protein, 47 aa, Homo sapiens
  ENSP00000457767
  MOD_RES (1)..(1): Any amino acid
XNEDDAKAARDAQECLALSPRLEYSGMISAHCNLHLLGSSDSPASAS

SEQ ID NO: 24769 - protein, 114 aa, Homo sapiens
  ENSP00000477687
RSRAALQRYLFYCNRYMNHMQSLRFEHKLYAQVKQKMEEMQQHNMSWIENNQADLENATEVLSGYLERDISQDSLQDIKQKVQDKYRYCESRRRVLLQHVHEGYEKDLWEYIED

SEQ ID NO: 24770 - protein, 200 aa, Homo sapiens
  ENSP00000379897
MGNGLSDQTSILSNLPSFQSFHIVILGLDCAGKTTVLYRLQFNEFVNTVPTKGFNTEKIKVTLGNSKTVTFHFWDVGGQEKLRPLWKSYTRCTDGIVFVVDSVDVERMEEAKTELHKITRISENQGVPVLIVANKQDLRNSLSLSEIEKLLAMGELSSSTPWHLQPTCAIIGDGLKEGLEKLHDMIIKRRKMLRQQKKKR

SEQ ID NO: 24771 - protein, 200 aa, Homo sapiens; identical to SEQ ID NO: 24770
  ENSP00000349250

SEQ ID NO: 24772 - protein, 200 aa, Homo sapiens; identical to SEQ ID NO: 24770
  ENSP00000379899

SEQ ID NO: 24773 - protein, 50 aa, Homo sapiens
  ENSP00000397651
MGNGLSDQTSILSNLPSFQSFHIVILGLDCAGKTTVLYRLQFNEFVNTVP

SEQ ID NO: 24774 - protein, 200 aa, Homo sapiens; identical to SEQ ID NO: 24770
  ENSP00000385236

SEQ ID NO: 24775 - protein, 200 aa, Homo sapiens; identical to SEQ ID NO: 24770
  ENSP00000379898

SEQ ID NO: 24776 - protein, 179 aa, Homo sapiens
  ENSP00000366487
MGLIFAKLWSLFCNQEHKVIIVGLDNAGKTTILYQFLMNEVVHTSPTIGSNVEEIVVKNTHFLMWDIGGQESLRSSWNTYYSNTEFIILVVDSIDRERLAITKEELYRMLAHEDLRKAAVLIFANKQDMKGCMTAAEISKYLTLSSIKDHPWHIQSCCALTGEGLCQGLEWMTSRIGVR

SEQ ID NO: 24777 - protein, 453 aa, Homo sapiens
  ENSP00000361917
MGRTREAGCVAAGVVIGAGACYCVYRLAWGRDENEKIWDEDEESTDTSEIGVETVKGAKTNAGAGSGAKLQGDSEVKPEVSLGLEDCPGVKEKAHSGSHSGGGLEAKAKALFNTLKEQASAKAGKGARVGTISGNRTLAPSLPCPGGRGGGCHPTRSGSRAGGRASGKSKGKARSKSTRAPATTWPVRRGKFNFPYKIDDILSAPDLQKVLNILERTNDPFIQEVALVTLGNNAAYSFNQNAIRELGGVPIIAKLIKTKDPIIREKTYNALNNLSVNAENQGKIKTYISQVCDDTMVCRLDSAVQMAGLRLLTNMTVTNHYQHLLSYSFPDFFALLFLGNHFTKIQIMKLIINFTENPAMTRELVSCKVPSELISLFNKEWDREILLNILTLFENINDNIKNEGLASSRKEFSRSSLFFLFKESGVCVKKIKALANHNDLVVKVKVLKVLTKL

SEQ ID NO: 24778 - protein, 717 aa, Homo sapiens
  ENSP00000307479
MATPAAVNPPEMASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 24779 - protein, 706 aa, Homo sapiens
  ENSP00000453651
MASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 24780 - protein, 706 aa, Homo sapiens; identical to SEQ ID NO: 24779
  ENSP00000453792

SEQ ID NO: 24781 - protein, 130 aa, Homo sapiens
  ENSP00000452961
MRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCIS

SEQ ID NO: 24782 - protein, 716 aa, Homo sapiens [sequence omitted]

SEQ ID NO: 24783 - protein, 104 aa, Homo sapiens
  ENSP00000411644
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEED

SEQ ID NO: 24784 - protein, 89 aa, Homo sapiens
  ENSP00000412411
MSEQGDLNQAIAEEGGTEQETATPENGIVKSESLDEEEKLELQRRLEAQNQERRKSKSGAGKGKLTRSLAVCEESSARPGGESLQDQTL

SEQ ID NO: 24785 - protein, 32 aa, Homo sapiens
  ENSP00000398598
MSEQGDLNQAIAEEGGTEQETATPENGIVKSE

SEQ ID NO: 24786 - protein, 793 aa, Homo sapiens
  ENSP00000405276
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 24787 - protein, 54 aa, Homo sapiens
  ENSP00000409808
MSEQGDLNQAIAEEGGTEQETATPENGIVKSESLDEEEKLELQRRLEAQNQERR

SEQ ID NO: 24788 - protein, 812 aa, Homo sapiens
  ENSP00000187397
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQQNRMHPFRDDRRSKSIEEREEEYQRVRERIFAHDSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 24789 - protein, 96 aa, Homo sapiens
  ENSP00000396324
MSEQGDLNQAIAEEGGTEQETATPENGIVKSESLDEEEKLELQRRLEAQNQERRKSKSGAGKGKLTRSLAVCEESSARPGGESLQDQVYPLAIIIN

SEQ ID NO: 24790 - protein, 94 aa, Homo sapiens
  ENSP00000409331
MSEQGDLNQAIAEEGGTEQETATPENGIVKSESLDEEEKLELQRRLEAQNQERRKSKSGAGKGKLTRSLAVCEESSARPGGESLQDQESIHLQL

SEQ ID NO: 24791 - protein, 98 aa, Homo sapiens
  ENSP00000415134
MSEQGDLNQAIAEEGGTEQETATPENGIVKSESLDEEEKLELQRRLEAQNQERRKSKSGAGKGKLTRSLAVCEESSARPGGESLQDQIAAKNTRILQA

SEQ ID NO: 24792 - protein, 43 aa, Homo sapiens
  ENSP00000413005
MSEQGDLNQAIAEEGGTEQETATPENGIVKSESLDEEEKLELQ

SEQ ID NO: 24793 - protein, 89 aa, Homo sapiens; identical to SEQ ID NO: 24784
  ENSP00000401602

SEQ ID NO: 24794 - protein, 89 aa, Homo sapiens; identical to SEQ ID NO: 24784
  ENSP00000417838

SEQ ID NO: 24795 - protein, 89 aa, Homo sapiens; identical to SEQ ID NO: 24784
  ENSP00000390151

SEQ ID NO: 24796 - protein, 89 aa, Homo sapiens; identical to SEQ ID NO: 24784
  ENSP00000379742

SEQ ID NO: 24797 - protein, 89 aa, Homo sapiens; identical to SEQ ID NO: 24784
  ENSP00000389754

SEQ ID NO: 24798 - protein, 101 aa, Homo sapiens
  ENSP00000412341
MSEQGDLNQAIAEEGGTEQETATPENGIVKSESLDEEEKLELQRRLEAQNQERRKSKSGAGKGKLTRSLAVCEESSARPGGESLQDQVYPLAIIINCMNGI

SEQ ID NO: 24799 - protein, 98 aa, Homo sapiens
  ENSP00000390169
MSEQGDLNQAIAEEGGTEQETATPENGIVKSESLDEEEKLELQRRLEAQNQERRKSKSGAGKGKLTRSLAVCEESSARPGGESLQDQESIHLQLSSFS

SEQ ID NO: 24800 - protein, 813 aa, Homo sapiens
  ENSP00000412326
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQSVCSQESLFVENSRLLEDSNICNETYKKRQLFRGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGQPFVNPDGTPAIYNPPTSQQPLRSAMVGQSQQQPPQQQPSPQPQQQVQPPQPQMAGPLVTQSVQGLQASSQSVQYPAVSFPPQHLLPVSPTQHFPMRDDVATQFGQMTLSRQSSGETPEPPSGPVYPSSLMPQPAQQPSYVIASTGQQLPTGGFSGSGPPISQQVLQPPPSPQGFVQQPPPAQMPVYYYPSGQYPTSTTQQYRPMAPVQYNAQRSQQMPQAAQQAGYQPVLSGQQGFQGLIGVQQPPQSQNVINNQQGTPVQSVMVSYPTMSSYQVPMTQGSQGLPQQSYQQPIMLPNQAGQGSLPATGMPVYCNVTPPTPQNNLRLIGPHCPSSTVPVMSASCRTNCASMSNAGWQVKF

SEQ ID NO: 24801 - protein, 89 aa, Homo sapiens; identical to SEQ ID NO: 24784
  ENSP00000379741

SEQ ID NO: 24802 - protein, 89 aa, Homo sapiens; identical to SEQ ID NO: 24784
  ENSP00000406964

SEQ ID NO: 24803 - protein, 89 aa, Homo sapiens; identical to SEQ ID NO: 24784
  ENSP00000397720

SEQ ID NO: 24804 - protein, 89 aa, Homo sapiens; identical to SEQ ID NO: 24784
  ENSP00000410171

SEQ ID NO: 24805 - protein, 145 aa, Homo sapiens
  ENSP00000399482
  MOD_RES (1)..(1): Any amino acid
XQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQLCPSVVHKLSWIINTDR

SEQ ID NO: 24806 - protein, 261 aa, Homo sapiens
  ENSP00000408271
  MOD_RES (1)..(1): Any amino acid
XFCRDRMILLKMEQEIIDFIADNNNHYKKFPQMSSYQRMLVHRVAAYFGLDHNVDQTGKSVIINKTSSTRIQFAPRKAFLWKTVGSWKTVTYAMRPIRKDSSFGWGNRDGSGRTSGSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTGE

SEQ ID NO: 24807 - protein, 124 aa, Homo sapiens
  ENSP00000396116
  MOD_RES (1)..(1): Any amino acid
XCRDRMILLKMEQEIIDFIADNNNHYKKFPQMSSYQRMLVHRVAAYFGLDHNVDQTGKSVIINKTSSTRIQFAPRKAFLWKTGATEMAQGEHLGVDRAAQKMNSSGLTTKGPGAAQTPTVPTAI

SEQ ID NO: 24808 - protein, 241 aa, Homo sapiens
  ENSP00000412233
GSRQSSSENELKWSDHQRAWSSTDSDSSNRNLKPAMTKTASFGGITVLTRGDSTSSTRSTGKLSKAGSESSSSAGSSGSLSRTHPPLQSTPLVSGVAAGSPGCVPYPENGIGGQVAPSSTSYILLPLEAATGIPPGSILLNPHTALCESRWNSCNIQPTHQSAAPAKRHGGAVPTAATTAAALPAAPTAGPATAATDGRPSGHSVCPGAAGFLPVSAISSSLFSSPAPPTCVSNAALSHER

SEQ ID NO: 24809 - protein, 418 aa, Homo sapiens
  ENSP00000409581
MGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGLLGDLASSDVAVELPFTLMHPKPKEEPPHREVPENETPVDTNLIELDTNDDDIVFEDFARQRLKGMKDDKEEEEDGTGSPQLNNR

SEQ ID NO: 24810 - protein, 410 aa, Homo sapiens
  ENSP00000353124
MGDKGTRVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVPENETPVDTNLIELDTNDDDIVFEDFARQRLKGMKDDKEEEEDGTGSPQLNNR

SEQ ID NO: 24811 - protein, 195 aa, Homo sapiens
  ENSP00000436530
  MOD_RES (1)..(1): Any amino acid
XRPGPQPTAETTRQFLMSDKPLHLEASLDKEIYYHGEPISVNVHVTNNTNKTVKKIKISVRQYADICLFNTAQYKCPVAMEEADDTVAPSSTFCKVYTLTPFLANNREKRGLALDGKLKHEDTNLASSTLLREGANREILGIIVSYKVKVKLVVSRGGDVAVELPFTLMHPKPKEEPPHREVMTTLYLRTLLARD

SEQ ID NO: 24812 - protein, 257 aa, Homo sapiens
  ENSP00000433171
MGVFKKASPNGKLTVYLGKRDFVDHIDLVDPVDGVVLVDPEYLKERRVYVTLTCAFRYGREDLDVLGLTFRKDLFVANVQSFPPAPEDKKPLTRLQERLIKKLGEHAYPFTFEIPPNLPCSVTLQPGPEDTGKACGVDYEVKAFCAENLEEKIHKRNSVRLVIRKVQYAPERPGPQPTAETTRQFLMSDKPLHLEASLDKEIYYHGEPISVNVHVTNNTNKTVKKIKISVRQYADICLFNTAQYKCPVAMEEADDTV

SEQ ID NO: 24813 - protein, 69 aa, Homo sapiens
  ENSP00000434196
  MOD_RES (1)..(1): Any amino acid
XGGRRRERPAAATARDGRGEAMEGDLQRERLSSPSTWESGTLWTTSTSWTLWMVWSWWILSISKSGESM

SEQ ID NO: 24814 - protein, 59 aa, Homo sapiens
  ENSP00000436352
SHCKRWERRGHGRRLAAGEAESVQEGQSKWKAHRLPGKAGLCGPHRPRGPCGWCGPGGS

SEQ ID NO: 24815 - protein, 72 aa, Homo sapiens
  ENSP00000433137
  MOD_RES (1)..(1): Any amino acid
XVCLPLPCRCSGETTPTPGPVPSAECSRRPVQMESSPSTWESGTLWTTSTSWTLWMVWSWWILSISKSGESM

SEQ ID NO: 24816 - protein, 414 aa, Homo sapiens
  ENSP00000265138
MVLGKVKSLTISFDCLNDSNVPVYSSGDTVSGRVNLEVTGEIRVKSLKIHARGHAKVRWTESRNAGSNTAYTQNYTEEVEYFNHKDILIGHERDDDNSEEGFHTIHSGRHEYAFSFELPQTPLATSFEGRHGSVRYWVKAELHRPWLLPVKLKKEFTVFEHIDINTPSLLSPQAGTKEKTLCCWFCTSGPISLSAKIERKGYTPGESIQIFAEIENCSSRMVVPKAAIYQTQAFYAKGKMKEVKQLVANLRGESLSSGKTETWNGKLLKIPPVSPSILDCSIIRVEYSLMVYVDIPGAMDLFLNLPLVIGTIPLHPFGSRTSSVSSQCSMNMNWLSLSLPERPEAPPSYAEVVTEEQRRNNLAPVSACDDFERALQGPLFAYIQEFRFLPPPLYSEIDPNPDQSADDRPSCPSR

SEQ ID NO: 24817 - protein, 525 aa, Homo sapiens
  ENSP00000407193
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 24818 - protein, 28 aa, Homo sapiens
  ENSP00000462306
MGWLFLKVLLAGVSFSGFLYPLVDFCIS

SEQ ID NO: 24819 - protein, 361 aa, Homo sapiens
  ENSP00000413953
MGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 24820 - protein, 525 aa, Homo sapiens; identical to SEQ ID NO: 24817
  ENSP00000480910

SEQ ID NO: 24821 - protein, 562 aa, Homo sapiens
  ENSP00000368332
MSNQYQEEGCSERPECKSKSPTLLSSYCIDSILGRRSPCKMRLLGAAQSLPAPLTSRADPEKAVQGSPKSSSAPFEAELHLPPKLRRLYGPGGGRLLQGAAAAAAAAAAAAAAAATATAGPRGEAPPPPPPTARPGERPDGAGAAAAAAAAAAAAWDTLKISQAPQVSISRSKSYRENGAPFVPPPPALDELGGPGGVTHPEERLGVAGGPGSAPAAGGGTGTEDDEEELLEDEEDEDEEEELLEDDEEELLEDDARALLKEPRRCPVAATGAVAAAAAAAVATEGGELSPKEELLLHPEDAEGKDGEDSVCLSAGSDSEEGLLKRKQRRYRTTFTSYQLEELERAFQKTHYPDVFTREELAMRLDLTEARVQVWFQNRRAKWRKREKAGAQTHPPGLPFPGPLSATHPLSPYLDASPFPPHHPALDSAWTAAAAAAAAAFPSLPPPPGSASLPPSGAPLGLSTFLGAAVFRHPAFISPAFGRLFSTMAPLTSASTAAALLRQPTPAVEGAVASGALADPATAAADRRASSIAALRLKAKEHAAQLTQLNILPGTSTGKEVC

SEQ ID NO: 24822 - protein, 48 aa, Homo sapiens
  ENSP00000490122
  MOD_RES (1)..(1): Any amino acid
XTFLGAAVFRHPAFISPAFGRLHLPCHSSDPLPTTPPYVQAPIYTAVQ

SEQ ID NO: 24823 - protein, 407 aa, Homo sapiens
  ENSP00000436150
MGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 24824 - protein, 903 aa, Homo sapiens
  ENSP00000338769
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDGIRRVWQKRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 24825 - protein, 203 aa, Homo sapiens
  ENSP00000435394
LEQAQAGTFAFPLHVDYSWVISTEPGSDSEEDEEEKRCLLKLPAQAHWASGRLDISNKTYETVASLGAATPQGENRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 24826 - protein, 44 aa, Homo sapiens
  ENSP00000435858
MPEQFSVAEFLAVTAEDLSSPAGAAAFAAKMPRSWKETKPSCRE

SEQ ID NO: 24827 - protein, 894 aa, Homo sapiens
  ENSP00000408826
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQASLSLGSRAKLEKERDRARVTGGIPGEVAQDMQRERRIFQLHMCEYLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDGIRRVWQKRKCGVKYGCLTISHSTINRPPVKLTLLTCQVRPNPEEKKCFDLVTHNRTYHFQAEDEHECEAWVSVLQNSKDEALSSAFLGEPSAGPGSWGSAGHDGEPHDLTKLLIAEVKSRPGNSQCCDCGAADPTWLSTNLGVLTCIQCSGVHRELGVRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQAPEELVLHLAVKVANQASLPLVDFIIQNGGHLDAKAADGNTALHYAALYNQPDCLKLLLKGRALVGTVNEAGETALDIARKKHHKECEELLEQAQAGTFAFPLHVDYSWVISTEPGSDSEEDEEEKRCLLKLPAQAHWASGRLDISNKTYETVASLGAATPQGESEDCPPPLPVKNSSRTLVQGCARHASGDRSEVSSLSSEAPETPESLGSPASSSSLMSPLEPGDPSQAPPNSEEGLREPPGTSRPSLTSGTTPSEMYLPVRFSSESTRSYRRGARSPEDGPSARQPLPRRNVPVGITEGDGSRTGSLPASSVQLLQD

SEQ ID NO: 24828 - protein, 124 aa, Homo sapiens
  ENSP00000434897
  MOD_RES (1)..(1): Any amino acid
XRFSRMQSLTLDLLGPSELLLALNMGNTSFNEVMEAQLPSHGGPKPSAESDMGTRRDYIMAKYVEHRFARRCTPEPQRLWTAICNRDLLSVLEAFANGQDFGQPLPGPDAQVRTPPRATYNPPV

SEQ ID NO: 24829 - protein, 120 aa, Homo sapiens
  ENSP00000436439
YLLKAGESQMKQGPDFLQSLIKFFHAQHNFFQDGWKAAQSLFPFIEKLAASVHALHQAQEDELQKLTQLRDSLRGTLQLESREEHLSRKNSGCGYSIHQHQGNKQFGTEKVGFLYKKSDG

SEQ ID NO: 24830 - protein, 157 aa, Homo sapiens
  ENSP00000476400
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAK

SEQ ID NO: 24831 - protein, 202 aa, Homo sapiens
  ENSP00000483740
MPEQFSVAEFLAVTAEDLSSPAGAAAFAAKMPRYRGAALAREEILEGDQAILQRIKKAVRAIHSSGLGHVENEEQYREAVESLGNSHLSQNSHELSTGFLNLAVFTREVAALFKNLIQNLNNIVSFPLDSLMKGQLRDGRQDSKKQLEKAWKDYEAKMAKLEKERDRARVTGGIPGNLGIPAKPHPTLKRASESPQAPPDPA

SEQ ID NO: 24832 - protein, 407 aa, Homo sapiens; identical to SEQ ID NO: 24823
  ENSP00000488934

SEQ ID NO: 24833 - protein, 903 aa, Homo sapiens; identical to SEQ ID NO: 24824
  ENSP00000488946

SEQ ID NO: 24834 - protein, 202 aa, Homo sapiens; identical to SEQ ID NO: 24831
  ENSP00000489432

SEQ ID NO: 24835 - protein, 203 aa, Homo sapiens; identical to SEQ ID NO: 24825
  ENSP00000489483

SEQ ID NO: 24836 - protein, 44 aa, Homo sapiens; identical to SEQ ID NO: 24826
  ENSP00000489485

SEQ ID NO: 24837 - protein, 894 aa, Homo sapiens; identical to SEQ ID NO: 24827
  ENSP00000488953

SEQ ID NO: 24838 - protein, 124 aa, Homo sapiens; identical to SEQ ID NO: 24828
  ENSP00000489344
  MOD_RES (1)..(1): Any amino acid

SEQ ID NO: 24839 - protein, 120 aa, Homo sapiens; identical to SEQ ID NO: 24829
  ENSP00000489094

SEQ ID NO: 24840 - protein, 157 aa, Homo sapiens; identical to SEQ ID NO: 24830
  ENSP00000489187

SEQ ID NO: 24841 - protein, 236 aa, Homo sapiens
  ENSP00000266744
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 24842 - protein, 291 aa, Homo sapiens
  ENSP00000269299
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 24843 - protein, 190 aa, Homo sapiens
  ENSP00000370307
MKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 24844 - protein, 162 aa, Homo sapiens
  ENSP00000467511
  MOD_RES (1)..(1): Any amino acid
XRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFK

SEQ ID NO: 24845 - protein, 252 aa, Homo sapiens
  ENSP00000459169
MTKEYQDLQHLDNEESDHHQLRKDSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 24846 - protein, 94 aa, Homo sapiens
  ENSP00000458530
MAALQGNGSERTCCPVNWVEHERSCYWFSRSGKAWADADNYCRLEDAHLVVVTSWEEQKFVQHHIGPVNTWMGLHDQNGPWKWVDGTDYETGFK

SEQ ID NO: 24847 - protein, 29 aa, Homo sapiens
  ENSP00000458803
MKSLESQLEKQQKDLSEDHSSLLLHVKQF

SEQ ID NO: 24848 - protein, 117 aa, Homo sapiens
  ENSP00000459896
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLS

SEQ ID NO: 24849 - protein, 252 aa, Homo sapiens; identical to SEQ ID NO: 24845
  ENSP00000481182

SEQ ID NO: 24850 - protein, 574 aa, Homo sapiens
  ENSP00000228468
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGELLMTPVPFSCHGHGVAPYHPKAGCSLLSHEGPPPQRPFPKPCCLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 24851 - protein, 528 aa, Homo sapiens
  ENSP00000400228
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 24852 - protein, 263 aa, Homo sapiens
  ENSP00000448263
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVKPMQVAKELRRCTLPGTVFQGTQRARKGLHTLWKVLHVQLGPRWAAAAEDHEGWDGQWAGNHAGHPAGRVPACVGGD

SEQ ID NO: 24853 - protein, 396 aa, Homo sapiens
  ENSP00000402896
  MOD_RES (1)..(1): Any amino acid
XIRDMLLSCHFRGEVCSAEDFKVKPMQVAKELRRCTLPGTVFQGTQRARKGEKQVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 24854 - protein, 562 aa, Homo sapiens
  ENSP00000450247
MPIQIFCSMSFSSGEEAPGPLGDIWGPHHHQQQQDISESEEEEEEKEKEAVRKEASEGHSPMDLVAFANSCTLHGTNHIFVEGGPGPRQVLWAVAFVLALGAFLCQVGDRVAYYLSYPHVTLLNEVATTELAFPAVTLCNTNAVRLSQLSYPDLLYLAPMLGLDESDDPGVPLAPPGPEAFSGEPFNLHRFYNRSCHRLEDMLLYCSYQGGPCGPHNFSVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 24855 - protein, 127 aa, Homo sapiens
  ENSP00000446863
  MOD_RES (1)..(1): Any amino acid
XENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 24856 - protein, 563 aa, Homo sapiens
  ENSP00000225823
MSRIGGAGLPAAALTGPGRFRMAREEPAPAALAAAGQPGGGRGGERALQGPGVARRGRPSLSRAKLHGLRHMCAGRTAAGGSFQRRALWVLAFCTSFGLLLSWSSNRLLYWLSFPSHTRVHREWSRQLPFPAVTVCNNNPLRFPRLSKGDLYYAGHWLGLLLPNRTARPLVSELLRGDEPRRQWFRKLADFRLFLPPRHFEGISAAFMDRLGHQLEDMLLSCKYRGELCGPHNFSSVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 24857 - protein, 512 aa, Homo sapiens
  ENSP00000352934
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRFSRLTTNDLYHAGELLALLDVNLQIPDPHLADPSVLEALRQKANFKHYKPKQFSMLEFLHRVGHDLKDMMLYCKFKGQECGHQDFTTVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 24858 - protein, 647 aa, Homo sapiens
  ENSP00000326627
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 24859 - protein, 666 aa, Homo sapiens
  ENSP00000350786
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 24860 - protein, 561 aa, Homo sapiens
  ENSP00000377846
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 24861 - protein, 401 aa, Homo sapiens
  ENSP00000401651
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKDWRGRKKNCFVCQKQNSWCFCL

SEQ ID NO: 24862 - protein, 478 aa, Homo sapiens
  ENSP00000414379
MQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 24863 - protein, 561 aa, Homo sapiens; identical to SEQ ID NO: 24860
  ENSP00000377845

SEQ ID NO: 24864 - protein, 540 aa, Homo sapiens
  ENSP00000414901
MKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 24865 - protein, 478 aa, Homo sapiens; identical to SEQ ID NO: 24862
  ENSP00000408472

SEQ ID NO: 24866 - protein, 540 aa, Homo sapiens; identical to SEQ ID NO: 24864
  ENSP00000406994

SEQ ID NO: 24867 - protein, 214 aa, Homo sapiens
  ENSP00000400422
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDVPLHA

SEQ ID NO: 24868 - protein, 162 aa, Homo sapiens
  ENSP00000394242
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAK

SEQ ID NO: 24869 - protein, 118 aa, Homo sapiens
  ENSP00000402350
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLD

SEQ ID NO: 24870 - protein, 63 aa, Homo sapiens
  ENSP00000408797
MKIAHRGPDAFRFENVNGYTNCCFGFHRLAVVDPLFGMQPIRVKKYPYLWLCYNGEIYNHKKV

SEQ ID NO: 24871 - protein, 32 aa, Homo sapiens
  ENSP00000397802
MCGIWALFGSDDCLSVQCLSAMKIAHRGPDAF

SEQ ID NO: 24872 - protein, 28 aa, Homo sapiens
  ENSP00000413797
MCGIWALFGSDDCLSVQCLSAMKIAHRG

SEQ ID NO: 24873 - protein, 561 aa, Homo sapiens; identical to SEQ ID NO: 24860
  ENSP00000175506

SEQ ID NO: 24874 - protein, 78 aa, Homo sapiens
  ENSP00000458324
MTSCHIAEEHIQKVAIFGGTHGNELTGVFLVKHWLENGAEIQRTGLEVKPFITNPRAVKKCTRYIDCDLNRIFDLENL

SEQ ID NO: 24875 - protein, 313 aa, Homo sapiens
  ENSP00000409976
MTSCHIAEEHIQKVAIFGGTHGNELTGVFLVKHWLENGAEIQRTGLEVKPFITNPRAVKKCTRYIDCDLNRIFDLENLGKKMSEDLPYEVRRAQEINHLFGPKDSEDSYDIIFDLHNTTSNMGCTLILEDSRNNFLIQMFHYIKTSLAPLPCYVYLIEHPSLKYATTRSIAKYPVGIEVGPQPQGVLRADILDQMRKMIKHALDFIHHFNEGKEFPPCAIEVYKIIEKVDYPRDENGEIAAIIHPNLQDQDWKPLHPGDPMFLTLDGKTIPLGGDCTVYPVFVNEAAYYEKKEAFAKTTKLTLNAKSIRCCLH

SEQ ID NO: 24876 - protein, 313 aa, Homo sapiens; identical to SEQ ID NO: 24875
  ENSP00000263080

SEQ ID NO: 24877 - protein, 56 aa, Homo sapiens
  ENSP00000461358
MTSCHIAEEHIQKVAIFGGTHGNELTGVFLVKHWLENGAEIQRTGLEQKNVRRFAI

SEQ ID NO: 24878 - protein, 573 aa, Homo sapiens
  ENSP00000450040
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 24879 - protein, 555 aa, Homo sapiens
  ENSP00000448911
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRQRQPGTWQWWPFYRAWRVRLVPRPHAQKCCLVSNLKASCCSISHSFLP

SEQ ID NO: 24880 - protein, 126 aa, Homo sapiens
  ENSP00000447032
  MOD_RES (1)..(1): Any amino acid
XPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPELLTKDLRGEMTPPSVEER

SEQ ID NO: 24881 - protein, 140 aa, Homo sapiens
  ENSP00000446856
AAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEPSCFQEVLPGV

SEQ ID NO: 24882 - protein, 440 aa, Homo sapiens
  ENSP00000288520
MNTLLCKGMFCLLSWEADSRGRLGEYTLQPLSLQTEETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 24883 - protein, 395 aa, Homo sapiens
  ENSP00000339925
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYYLTLSKVSPF

SEQ ID NO: 24884 - protein, 1062 aa, Homo sapiens
  ENSP00000363098
QTHNSVIGVPIRETPILDDYDCEEDEEPPRRANHVSREDEFGSQVTHTLDSLGHPGEEKVDFEKKAAAEATQETVESLMQKFKESFRANTPIEIGQLQPPLRSTSAGKRKRRSKSRGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 24885 - protein, 1288 aa, Homo sapiens
  ENSP00000354504
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 24886 - protein, 98 aa, Homo sapiens
  ENSP00000412099
  MOD_RES (1)..(1): Any amino acid
XMAYNTLMEVSASMLFRVQHHYNSHYEKFGDFVWRSEDELGPSLLESFMSLQDINLLERRPGRPQRPGNPLSNVSWRISEIAPTSHTDMSAGIKETAS

SEQ ID NO: 24887 - protein, 194 aa, Homo sapiens
  ENSP00000351460
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTVYCWITFIDLRILNQPCIPGMKPT

SEQ ID NO: 24888 - protein, 402 aa, Homo sapiens
  ENSP00000355116
MPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGRYYLTLSKVSPF

SEQ ID NO: 24889 - protein, 1339 aa, Homo sapiens
  ENSP00000314038
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKAAAEATQETVESLMQKFKESFRANTPIEIGQLQPPLRSTSAGKRKRRSKSRGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 24890 - protein, 64 aa, Homo sapiens
  ENSP00000429331
MVVLRSSLELHNHSAASATGSLDLSSDFLSLEHIGRRRLRSAGAAQKKPAATTAKAGAVGQTAG

SEQ ID NO: 24891 - protein, 1390 aa, Homo sapiens
  ENSP00000287394
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKEARKEILKIHTRDWNPKPLDTFLEELAENCVGYCGADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 24892 - protein, 708 aa, Homo sapiens
  ENSP00000429213
MQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 24893 - protein, 63 aa, Homo sapiens
  ENSP00000429617
MVVLRSSLELHNHSAASATGSLDLSSDFLSLEHIGRRRLRSAGAAQKKPAATTAKAGVRWVIS

SEQ ID NO: 24894 - protein, 175 aa, Homo sapiens
  ENSP00000355948
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIK

SEQ ID NO: 24895 - protein, 181 aa, Homo sapiens
  ENSP00000344352
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 24896 - protein, 153 aa, Homo sapiens
  ENSP00000355952
  MOD_RES (1)..(1): Any amino acid
XERSLEQNDASTPRPELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 24897 - protein, 106 aa, Homo sapiens
  ENSP00000336908
MMLQHPGQVSASEEELRFAIQNKHLCHRMSSALESVTVSDRPLGVSITKAEVAPEEDERKKRRRERNKIAAAKCRNKKKEKTECLQKLPRPFWVQKTCIWAVDSCK

SEQ ID NO: 24898 - protein, 135 aa, Homo sapiens
  ENSP00000432208
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKLPRPFWVQKTCIWAVDSCK

SEQ ID NO: 24899 - protein, 135 aa, Homo sapiens; identical to SEQ ID NO: 24898
  ENSP00000355950

SEQ ID NO: 24900 - protein, 124 aa, Homo sapiens
  ENSP00000480606
MSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 24901 - protein, 181 aa, Homo sapiens; identical to SEQ ID NO: 24895
  ENSP00000355954

SEQ ID NO: 24902 - protein, 124 aa, Homo sapiens; identical to SEQ ID NO: 24900
  ENSP00000483576

SEQ ID NO: 24903 - protein, 703 aa, Homo sapiens
  ENSP00000404725
MAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 24904 - protein, 700 aa, Homo sapiens
  ENSP00000391131
MAELMLLSEIADPTRFFTDNLLSPEDWDSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 24905 - protein, 142 aa, Homo sapiens
  ENSP00000399944
  MOD_RES (1)..(1): Any amino acid
XQPSPTDQPSFSNLTAFPGGAKELLLRDLDQLFLSSDCRHFNRTESLRLADELSGWVQRHQRGRRKIPQRAQERQSLDTSPSRSLSHGRSHLQLRQSPSNPLDPQKGILWASCNYIATQTVRSQHSWMQLTDGKTHFMLSLS

SEQ ID NO: 24906 - protein, 703 aa, Homo sapiens; identical to SEQ ID NO: 24903
  ENSP00000364349

SEQ ID NO: 24907 - protein, 700 aa, Homo sapiens; identical to SEQ ID NO: 24904
  ENSP00000364347

SEQ ID NO: 24908 - protein, 142 aa, Homo sapiens; identical to SEQ ID NO: 24905
  ENSP00000393419
  MOD_RES (1)..(1): Any amino acid

SEQ ID NO: 24909 - protein, 703 aa, Homo sapiens; identical to SEQ ID NO: 24903
  ENSP00000404814

SEQ ID NO: 24910 - protein, 700 aa, Homo sapiens; identical to SEQ ID NO: 24904
  ENSP00000399764

SEQ ID NO: 24911 - protein, 142 aa, Homo sapiens; identical to SEQ ID NO: 24905
  ENSP00000389467
  MOD_RES (1)..(1): Any amino acid

SEQ ID NO: 24912 - protein, 703 aa, Homo sapiens; identical to SEQ ID NO: 24903
  ENSP00000293709

SEQ ID NO: 24913 - protein, 700 aa, Homo sapiens; identical to SEQ ID NO: 24904
  ENSP00000372642

SEQ ID NO: 24914 - protein, 142 aa, Homo sapiens; identical to SEQ ID NO: 24905
  ENSP00000412066
  MOD_RES (1)..(1): Any amino acid

SEQ ID NO: 24915 - protein, 583 aa, Homo sapiens
  ENSP00000368237
MAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 24916 - protein, 413 aa, Homo sapiens
  ENSP00000385446
MDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQRSPRKVFSKLFEVTRRRMVHRALSSAQRQRLSSNNNKKKN

SEQ ID NO: 24917 - protein, 412 aa, Homo sapiens
  ENSP00000384062
MDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 24918 - protein, 49 aa, Homo sapiens
  ENSP00000383944
MAEGDEAARGQQPHQGLWRRRRTSDPSAAVNHVSSTTSLGFSKLDWWKQ

SEQ ID NO: 24919 - protein, 579 aa, Homo sapiens
  ENSP00000415336
MAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVFSKLFEVTRRRMVHRALSSAQRQRLSSNNNKKKN

SEQ ID NO: 24920 - protein, 565 aa, Homo sapiens
  ENSP00000390743
MVLKKGIKFFQRLINSKSLRFGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 24921 - protein, 175 aa, Homo sapiens
  ENSP00000409811
MAEGDEAARGQQPHQGLWRRRRTSDPSAAVNHVSSTTSLEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFK

SEQ ID NO: 24922 - protein, 258 aa, Homo sapiens
  ENSP00000410592
  MOD_RES (1)..(1): Any amino acid
XEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVE

SEQ ID NO: 24923 - protein, 86 aa, Homo sapiens
  ENSP00000413216
MAEGDEAARGQQPHQGLWRRRRTSDPSAAVNHVSSTTSLESCSVARLECSGTIFAYCNLPGSSDSSASASQVAGITGFSKLDWWKQ

SEQ ID NO: 24924 - protein, 185 aa, Homo sapiens
  ENSP00000404921
MAEGDEAARGQQPHQGLWRRRRTSDPSAAVNHVSSTTSLESCSVARLECSGTIFAYCNLPGSSDSSASASQVAGITGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETT

SEQ ID NO: 24925 - protein, 93 aa, Homo sapiens
  ENSP00000406004
MAEGDEAARGQQPHQGLWRRRRTSDPSAAVNHVSSTTSLDGVSLCRPGWGAVARSRLTASSASWVHAILRPQPPEYLGLQAPATVSGLLFLYF

SEQ ID NO: 24926 - protein, 413 aa, Homo sapiens; identical to SEQ ID NO: 24916
  ENSP00000486809

SEQ ID NO: 24927 - protein, 541 aa, Homo sapiens
  ENSP00000381844
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 24928 - protein, 523 aa, Homo sapiens
  ENSP00000437593
MESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 24929 - protein, 169 aa, Homo sapiens
  ENSP00000441842
MRTAGRDPVSAGLQFPKDGSTQRPANRARFVPARTRPSPLHPCCFCFEGGGSMLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETT

SEQ ID NO: 24930 - protein, 321 aa, Homo sapiens
  ENSP00000304676
MKHIPVLEDGPWKTVCVKELNGLKKLKRKGKEPARRANGYKTFRLDLEAPEPRAVATNGLRDRTHRLQPVPVPVPVPVPVAPAVPPRGGTDTAGERGGSRAPEVSDARKRCFALGAVGPGLPTPPPPPPPAPQSQAPGGPEAQPFREPGLRPRILLCAPPARPAPSAPPAPPAPPESTVRPAPPTRPGESSYSSISHVIYNNHQDSSASPRKRPGEATAASSEIKALQQTRRLLANARERTRVHTISAAFEALRKQVPCYSYGQKLSKLAILRIACNYILSLARLADLDYSADHSNLSFSECVQRCTRTLQAEGRAKKRKE

SEQ ID NO: 24931 - protein, 212 aa, Homo sapiens
  ENSP00000383129
MHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 24932 - protein, 576 aa, Homo sapiens
  ENSP00000395367
  MOD_RES (1)..(1): Any amino acid
XGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQRQTAFQITSFCSRIWPLQLLLV

SEQ ID NO: 24933 - protein, 83 aa, Homo sapiens
  ENSP00000402023
MGHFEKGQHALLNEGEENEMEIFGYRTQGCRKSLCLAGSIFSFGILPLVFYWRPAWHVWAHCVPCSLQEADTVLLRTTMRSIS

SEQ ID NO: 24934 - protein, 1177 aa, Homo sapiens
  ENSP00000376238
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQYVGVLLLYWETNSLSNYQFLFQDLAITTLIGVTMNLNGAYPKLVPFRPAGRLISPPLLLSVIFNILLSLAMHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 24935 - protein, 1196 aa, Homo sapiens
  ENSP00000339182
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQYVGVLLLYWETNSLSNYQFLFQDLAITTLIGVTMNLNGAYPKLVPFRPAGRLISPPLLLSVIFNILLSLAMHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 24936 - protein, 122 aa, Homo sapiens
  ENSP00000401481
  MOD_RES (1)..(1): Any amino acid
XNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLE

SEQ ID NO: 24937 - protein, 576 aa, Homo sapiens
  ENSP00000295548
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWVSLCSSENLRSFFNARAT

SEQ ID NO: 24938 - protein, 106 aa, Homo sapiens
  ENSP00000400124
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLS

SEQ ID NO: 24939 - protein, 1023 aa, Homo sapiens
  ENSP00000295598
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 24940 - protein, 144 aa, Homo sapiens
  ENSP00000358506
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNG

SEQ ID NO: 24941 - protein, 157 aa, Homo sapiens
  ENSP00000396236
RQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKTLTQYS

SEQ ID NO: 24942 - protein, 992 aa, Homo sapiens
  ENSP00000358508
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 24943 - protein, 1023 aa, Homo sapiens
  ENSP00000445306
MAFKVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 24944 - protein, 1020 aa, Homo sapiens
  ENSP00000354490
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 24945 - protein, 1009 aa, Homo sapiens
  ENSP00000376066
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLNLLIFIYDEVRKLILRRYPGGWVEKETYY

SEQ ID NO: 24946 - protein, 714 aa, Homo sapiens
  ENSP00000411705
  MOD_RES (1)..(1): Any amino acid
XQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 24947 - protein, 1226 aa, Homo sapiens
  ENSP00000411503
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGEGARQGSRGGRGAAGSQAAGPRLPSPCWMALPPGSHSSLSSHLSGHPLCLLTGLCLCGFLVSLPLCPSLCWAARLACLSPSLTLSLSFLLCLSRLGGEGNLLLTSAPPHRPSLPRPPGPGPPLSVPPILYSGGRSPLFLWPHLGPHPLHYLLPPPLWLASLPCPKPLSSLFSVSVSLPLLTPLSIPPAPATSLGSFLLPFSPPADAISGSGQLSNISVGRE

SEQ ID NO: 24948 - protein, 1013 aa, Homo sapiens
  ENSP00000302397
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 24949 - protein, 983 aa, Homo sapiens
  ENSP00000471581
MTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 24950 - protein, 1026 aa, Homo sapiens
  ENSP00000444688
MGSGGSDSYRIATSQDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 24951 - protein, 1024 aa, Homo sapiens
  ENSP00000437577
MGGWEEERNRRATDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 24952 - protein, 251 aa, Homo sapiens
  ENSP00000469129
MTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHF

SEQ ID NO: 24953 - protein, 1 aa, Homo sapiens
  ENSP00000489877
M

SEQ ID NO: 24954 - protein, 130 aa, Homo sapiens
  ENSP00000477015
MLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGF

SEQ ID NO: 24955 - protein, 303 aa, Homo sapiens
  ENSP00000356789
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 24956 - protein, 303 aa, Homo sapiens; identical to SEQ ID NO: 24955
  ENSP00000356790

SEQ ID NO: 24957 - protein, 166 aa, Homo sapiens
  ENSP00000459145
MIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKF

SEQ ID NO: 24958 - protein, 290 aa, Homo sapiens
  ENSP00000250111
MVIQKEKKSCGQVVEEWKEFVWNPRTHQFMGRTGTSWAFILLFYLVFYGFLTAMFTLTMWVMLQTVSDHTPKYQDRLATPGLMIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 24959 - protein, 172 aa, Homo sapiens
  ENSP00000460499
  MOD_RES (1)..(1): Any amino acid
XEQPDNGVLNYPKRACQFNRTQLGNCSGIGDSTHYGYSTGQPCVFIKMNRVINFYAGANQSMNVTCAGKRPHHHRNKGKLIPEDGRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 24960 - protein, 133 aa, Homo sapiens
  ENSP00000417522
MWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRID

SEQ ID NO: 24961 - protein, 279 aa, Homo sapiens
  ENSP00000286371
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 24962 - protein, 44 aa, Homo sapiens
  ENSP00000418280
MTKNEKKSLNQSLAEWKLFIYNPTTGEFLGRTAKSWGSQYVVGK

SEQ ID NO: 24963 - protein, 43 aa, Homo sapiens
  ENSP00000418952
  MOD_RES (1)..(1): Any amino acid
XKNEKKSLNQSLAEWKLFIYNPTTGEFLGRTAKSWGSQYVVGK

SEQ ID NO: 24964 - protein, 89 aa, Homo sapiens
  ENSP00000418353
MGSWLHSSHSRCGLCFRLSTMRFQNTVTRFLAQVGYLQPLVAVQVSFAPNNTGKEVTVECKIDGSANLKSQDDRDKFLGRVMFKITARA

SEQ ID NO: 24965 - protein, 119 aa, Homo sapiens
  ENSP00000419962
MLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGAL

SEQ ID NO: 24966 - protein, 27 aa, Homo sapiens
  ENSP00000417608
IIGLKPEGVPRIDCVSKLVGVLVISAI

SEQ ID NO: 24967 - protein, 999 aa, Homo sapiens
  ENSP00000380234
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 24968 - protein, 1029 aa, Homo sapiens
  ENSP00000380229
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGLASLKK

SEQ ID NO: 24969 - protein, 153 aa, Homo sapiens
  ENSP00000461480
ESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGARDTASSRCQSCSEREEAGKK

SEQ ID NO: 24970 - protein, 1052 aa, Homo sapiens
  ENSP00000353072
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGLASLGQGHSIVSLSELLREGGSREEMSQK

SEQ ID NO: 24971 - protein, 1043 aa, Homo sapiens
  ENSP00000301387
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGRNEPEVSAGNRVESPVCTSD

SEQ ID NO: 24972 - protein, 998 aa, Homo sapiens
  ENSP00000380236
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEMSQK

SEQ ID NO: 24973 - protein, 142 aa, Homo sapiens
  ENSP00000458865
ESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHGPGTQHRLAVRAAQRGRKQGRNEPEVSAGNRVESPVCTSD

SEQ ID NO: 24974 - protein, 1029 aa, Homo sapiens; identical to SEQ ID NO: 24968
  ENSP00000312577

SEQ ID NO: 24975 - protein, 1243 aa, Homo sapiens [sequence omitted]

SEQ ID NO: 24976 - protein, 1198 aa, Homo sapiens
  ENSP00000373311
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 24977 - protein, 1154 aa, Homo sapiens
  ENSP00000424494
MGDMTNSDFYSKNQRNESSHGGEFGCTMEELRSLMELRGTEAVVKIKETYGDTEAICRRLKTSPVEGLPGTAPDLEKRKQIFGQNFIPPKKPKTFLQLVWEALQDVTLIILEIAAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIEVVNTFKSGASFQGALRRQSSVTSQSQDVANLSSPSRVSLSNALSSPTSLPPAAAGQG

SEQ ID NO: 24978 - protein, 1198 aa, Homo sapiens; identical to SEQ ID NO: 24976
  ENSP00000380267

SEQ ID NO: 24979 - protein, 1099 aa, Homo sapiens
  ENSP00000414854
AAIISLGLSFYHPPGEGNEGCATAQGGAEDEGEAEAGWIEGAAILLSVICVVLVTAFNDWSKEKQFRGLQSRIEQEQKFTVVRAGQVVQIPVAEIVVGDIAQVKYGDLLPADGLFIQGNDLKIDESSLTGESDQVRKSVDKDPMLLSGTHVMEGSGRMLVTAVGVNSQTGIIFTLLGAGGEEEEKKDKKGKMQDGNVDASQSKAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKKMMKDNNLVRHLDACETMGNATAICSDKTGTLTTNRMTVVQAYVGDVHYKEIPDPSSINTKTMELLINAIAINSAYTTKILPPEKEGALPRQVGNKTECGLLGFVLDLKQDYEPVRSQMPEEKLYKVYTFNSVRKSMSTVIKLPDESFRMYSKGASEIVLKKCCKILNGAGEPRVFRPRDRDEMVKKVIEPMACDGLRTICVAYRDFPSSPEPDWDNENDILNELTCICVVGIEDPVRPEVPEAIRKCQRAGITVRMVTGDNINTARAIAIKCGIIHPGEDFLCLEGKEFNRRIRNEKGEIEQERIDKIWPKLRVLARSSPTDKHTLVKGIIDSTHTEQRQVVAVTGDGTNDGPALKKADVGFAMGIAGTDVAKEASDIILTDDNFSSIVKAVMWGRNVYDSISKFLQFQLTVNVVAVIVAFTGACITQDSPLKAVQMLWVNLIMDTFASLALATEPPTETLLLRKPYGRNKPLISRTMMKNILGHAVYQLALIFTLLFVGEKMFQIDSGRNAPLHSPPSEHYTIIFNTFVMMQLFNEINARKIHGERNVFDGIFRNPIFCTIVLGTFAIQIVIVQFGGKPFSCSPLQLDQWMWCIFIGLGELVWGQVIATIPTSRLKFLKEAGRLTQKEEIPEEELNEDVEEIDHAERELRRGQILWFRGLNRIQTQIRVVKAFRSSLYEGLEKPESRTSIHNFMAHPEFRIEDSQPHIPLIDDTDLEEDAALKQNSSPPSSLNKNNSAIDSGINLTTDTSKSATSSSPGSPIHSLETSL

SEQ ID NO: 24980 - protein, 1154 aa, Homo sapiens; identical to SEQ ID NO: 24977
  ENSP00000492732

SEQ ID NO: 24981 - protein, 1243 aa, Homo sapiens [sequence omitted]

SEQ ID NO: 24982 - protein, 1220 aa, Homo sapiens
  ENSP00000343886
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 24983 - protein, 1159 aa, Homo sapiens
  ENSP00000359205
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 24984 - protein, 1154 aa, Homo sapiens
  ENSP00000377425
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGSES

SEQ ID NO: 24985 - protein, 1173 aa, Homo sapiens
  ENSP00000352062
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 24986 - protein, 1220 aa, Homo sapiens; identical to SEQ ID NO: 24982
  ENSP00000263519

SEQ ID NO: 24987 - protein, 946 aa, Homo sapiens
  ENSP00000262429
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 24988 - protein, 975 aa, Homo sapiens
  ENSP00000397925
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQRSSQKTEVCCTAVRLGVEGRGESTWAGRAGLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 24989 - protein, 53 aa, Homo sapiens
  ENSP00000456595
  MOD_RES (1)..(1): Any amino acid
XVWKKYLDQFKNPLILLLLGSALVSVLTKEYEDAVSIATAVLVVVTVAFIQHI

SEQ ID NO: 24990 - protein, 86 aa, Homo sapiens
  ENSP00000432994
MWSNLGIGLAISLSVVGAAWGIYITGSSIIGGGVKAPRIKTKNLVSIIFCEAVAIYGIIMAIVISNMAEPFSATDPKAIGHRNYHA

SEQ ID NO: 24991 - protein, 205 aa, Homo sapiens
  ENSP00000431605
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 24992 - protein, 261 aa, Homo sapiens
  ENSP00000434729
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQVMNPLGKPLCPCPQPSLTLLLEKLKCSPSLPITIDSPKQLPPPHFHLLVFSYRGSLFLSLIWCH

SEQ ID NO: 24993 - protein, 158 aa, Homo sapiens
  ENSP00000236067
MWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 24994 - protein, 252 aa, Homo sapiens
  ENSP00000432754
MTGLALLYSGVFVAFWACALAVGEAGSWRAGAASRPSWPGRNSAGKWPAGNTGPPRALHPRLWGLAPARASDSDKGDPDFQLLEEGFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 24995 - protein, 46 aa, Homo sapiens
  ENSP00000435396
MTGLALLYSGVFVAFWACALAVAVLSPGGSLRTPLQGGGPSARQLL

SEQ ID NO: 24996 - protein, 88 aa, Homo sapiens
  ENSP00000431375
  MOD_RES (1)..(1): Any amino acid
XAVGEAGSWRAGAASRPSWPGRNSAGKWPAGNTGPPRALHPRLWGLAPARASDSDKGDPDFQLLEEGCGRESATPFLIWASALMWHGS

SEQ ID NO: 24997 - protein, 158 aa, Homo sapiens; identical to SEQ ID NO: 24993
  ENSP00000434094

SEQ ID NO: 24998 - protein, 75 aa, Homo sapiens
  ENSP00000426495
NLQLLGATAIEDKLQDQVPETIETLMKADIKIWILTGDKQETAINIGHSCKLLKKNMGMIVINEGSLDGFSSSKI

SEQ ID NO: 24999 - protein, 1164 aa, Homo sapiens
  ENSP00000371084
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 25000 - protein, 1149 aa, Homo sapiens
  ENSP00000264449
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVNVGDIVIIKGKEYIPADTVLLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 25001 - protein, 142 aa, Homo sapiens
  ENSP00000421164
  MOD_RES (1)..(1): Any amino acid
XAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVFVRFRCLQQCLL

SEQ ID NO: 25002 - protein, 113 aa, Homo sapiens
  ENSP00000426935
VSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIENTDIQANNNLYSLFT

SEQ ID NO: 25003 - protein, 29 aa, Homo sapiens
  ENSP00000427295
KRHKADNAVNKKQTQVLRNGAWEIVHWEK

SEQ ID NO: 25004 - protein, 55 aa, Homo sapiens
  ENSP00000426636
MPTMRRTVSEIRSRAEGYEKTDDVSEKTSLADQEEVRTIFINQPQLTKFCNNHVR

SEQ ID NO: 25005 - protein, 1251 aa, Homo sapiens
  ENSP00000283684
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLILLGATAIEDKLQDGVPETISKLAKADIKIWVLTGDKKETAENIGFACELLTEDTTICYGEDINSLLHARMENQRNRGGVYAKFAPPVQESFFPPGGNRALIITGSWLNEILLEKKTKRNKILKLKFPRTEEERRMRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQDVSDKLSLRFPGLYIVGQRDLLFNYKRFFVSLLHGVLTSMILFFIPLGAYLQTVGQDGEAPSDYQSFAVTIASALVITVNFQIGLDTSYWTFVNAFSIFGSIALYFGIMFDFHSAGIHVLFPSAFQFTGTASNALRQPYIWLTIILAVAVCLLPVVAIRFLSMTIWPSESDKIQKHRKRLKAEEQWQRRQQVFRRGVSTRRSAYAFSHQRGYADLISSGRSIRKKRSPLDAIVADGTAEYRRTGDS

SEQ ID NO: 25006 - protein, 92 aa, Homo sapiens
  ENSP00000468266
MYYAEKDTPAKARTTTLNEQLGQIHYIFSDKTGTLTQNIMTFKKCCINGQIYGDHRDASQHNHNKIEQVDFSWNTYADGKLAFYDHYLIEQI

SEQ ID NO: 25007 - protein, 61 aa, Homo sapiens
  ENSP00000467767
MSTERDSETTFDEDSQPNDEVVPYSDDETEDELDDQGSAVEPEQNRVNREAEENREPFRKE

SEQ ID NO: 25008 - protein, 11 aa, Homo sapiens
  ENSP00000468751
MSTERDSETTF

SEQ ID NO: 25009 - protein, 36 aa, Homo sapiens
  ENSP00000483722
MPECDWRQPSGGDGGWDLSLLTGERDSDGRRDFARE

SEQ ID NO: 25010 - protein, 467 aa, Homo sapiens
  ENSP00000476902
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHICELLKNCNFFIDWECFSL

SEQ ID NO: 25011 - protein, 252 aa, Homo sapiens
  ENSP00000431423
MPECDWRQPSGGDGGWDLSLLTGERDSDGRRLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWV

SEQ ID NO: 25012 - protein, 398 aa, Homo sapiens
  ENSP00000473412
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLKKTSLCMEAELKQMMAMSQMNYGFLTYIVSHGVQKLLLFLDMVSSMLWRDIQHILWSWIVEMLS

SEQ ID NO: 25013 - protein, 1379 aa, Homo sapiens
  ENSP00000347152
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHISSNTWLVPETKGAIVQGGYGHTSVYDEITKSIYVHGGYKALPGNKYGLVDDLYKYEVNTKTWTILKESGFARYLHSAVLINGAMLIFGGNTHNDTSLSNGAKCFSADFLAYDIACDEWKILPKPNLHRDVNRFGHSAVVINGSMYIFGGFSSVLLNDILVYKPPNCKAFRDEELCKNAGPGIKCVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 25014 - protein, 216 aa, Homo sapiens
  ENSP00000434118
  MOD_RES (1)..(1): Any amino acid
XCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACTCSGHANICHLHTGKCFCTTKGIKGDQCQLCDSENRYVGNPLRGTCYYSLLIDYQFTFSLLQEDDRHHTAIN

SEQ ID NO: 25015 - protein, 815 aa, Homo sapiens
  ENSP00000244769
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGK

SEQ ID NO: 25016 - protein, 815 aa, Homo sapiens; identical to SEQ ID NO: 25015
  ENSP00000416360

SEQ ID NO: 25017 - protein, 103 aa, Homo sapiens
  ENSP00000474312
MAVRERAAAAMAALERRVPSLDDFAGQSWSSWVERADLPAADETEVQGQPLPKGPLRRGGTCIADQGDFEDAQGPKTAVSLLCDHPISAGPEKLGVTLTMLWG

SEQ ID NO: 25018 - protein, 722 aa, Homo sapiens
  ENSP00000358886
MAVRERAAAAMAALERRVPSLDDFAGQSWSSWVERADLPAADGAELEESSKNTKKLDAMTLIKEDMSIFGHCPAHDDFYLVVCNHCSQVVKPQAFQKHCERRHGPLSKLYGRAPPPPPAPASSQKCHVVNGQGPACRAPGSTKTSSREKGQGSRSRGHQPPEKTQKDNLCQPGGLTKDSPGKPPMAPPSKEPPGRENIEIIPSEGSSHWAEGSPPEKEPSGTRLPPKTHRKMARKECDLNRQCGVINPETKKICTRLLTCKIHSVHQRREVQGRAKDFDVLVAELKANSRKGESPKEKSPGRKEQVLERPSQELPSSVQVVAAVAAPSSTFSVRAKQTYPYCALPRSRASSESELDDEGPCGGDGDPGLFPFPMPRGGTQASSEESEEEGTSDDLHPPPDCHYATRPPRPQAFCTFGSRLVSPGCYVFSRRLDRFCSALSSMLERHLSTHMWKKIPPAAEPPAHLVNSPLSAPLSPSSTGTCPRLPGPTLRPACPASMPPTKDNLVPSYPAGSPSVAAACSQAECMGGSQAITSPLPANTPSPSFSKLPPSKASKSSKGKDGVEVEAPSRKRKLSPGPTTLKRTCILEPTGKGKPSGCRGLSAKTKTALSMGLNGTMGPRVKRAGPLDCRGSPHQLPTPVKASQLENRGAAGHPAKALPTNCLSEEEVAKKRKNLATYCRPVKAKHCQAGAPADVACSVRRKKPGPALAFEEKCSTLKSKAH

SEQ ID NO: 25019 - protein, 147 aa, Homo sapiens
  ENSP00000359660
MGTPASVVSEPPPWQAPIEARGRKQASANIFQDAELLQIQALFQRSGDQLAEERAQIIWECAGDHRVAEALKRLRRKRPPRQKPLGHSLHHCSRLRILEPHSALANPQSATETASSEQYLHSRKKSARIRRNWRKSGPTSYLHQIRH

SEQ ID NO: 25020 - protein, 894 aa, Homo sapiens
  ENSP00000301178
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 25021 - protein, 885 aa, Homo sapiens
  ENSP00000351995
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 25022 - protein, 626 aa, Homo sapiens
  ENSP00000471497
MGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 25023 - protein, 298 aa, Homo sapiens
  ENSP00000292401
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 25024 - protein, 85 aa, Homo sapiens
  ENSP00000389942
  MOD_RES (1)..(1): Any amino acid
XTYIYTGLSKHVEDVPAFQALGSLNDLQFFRYNSKDRKSQPMGLWRQQKYPGPARSSLCGGHQPPGPRRKEETEVPGLRLLPREN

SEQ ID NO: 25025 - protein, 227 aa, Homo sapiens
  ENSP00000396093
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQGTHCFLLPSTEPRIKDDLRLGAQATS

SEQ ID NO: 25026 - protein, 448 aa, Homo sapiens
  ENSP00000337180
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEA

SEQ ID NO: 25027 - protein, 448 aa, Homo sapiens; identical to SEQ ID NO: 25026
  ENSP00000321507

SEQ ID NO: 25028 - protein, 165 aa, Homo sapiens
  ENSP00000475919
MKGFIDDANYSVGLLDEGTNLGNVIDNYVYEHTLNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAG

SEQ ID NO: 25029 - protein, 97 aa, Homo sapiens
  ENSP00000429449
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMAL

SEQ ID NO: 25030 - protein, 33 aa, Homo sapiens
  ENSP00000429215
MKGFIDDANYSVGLLDEGTNLGNVIDNYVYEHT

SEQ ID NO: 25031 - protein, 378 aa, Homo sapiens
  ENSP00000414880
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 25032 - protein, 378 aa, Homo sapiens; identical to SEQ ID NO: 25031
  ENSP00000398660

SEQ ID NO: 25033 - protein, 378 aa, Homo sapiens; identical to SEQ ID NO: 25031
  ENSP00000372696

SEQ ID NO: 25034 - protein, 378 aa, Homo sapiens; identical to SEQ ID NO: 25031
  ENSP00000394876

SEQ ID NO: 25035 - protein, 378 aa, Homo sapiens; identical to SEQ ID NO: 25031
  ENSP00000390784

SEQ ID NO: 25036 - protein, 323 aa, Homo sapiens
  ENSP00000230053
MKSALFTRFFILLPWILIVIIMLDVDTRRPVPPLTPRPYFSPYAVGRGGARLPLRRGGPAHGTQKRNQSRPQPQPEPQLPTIYAITPTYSRPVQKAELTRLANTFRQVAQLHWILVEDAAARSELVSRFLARAGLPSTHLHVPTPRRYKRPGLPRATEQRNAGLAWLRQRHQHQRAQPGVLFFADDDNTYSLELFQEMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVLVWHTRTEKVNLANEPKYHLDTVKIEV

SEQ ID NO: 25037 - protein, 251 aa, Homo sapiens
  ENSP00000481320
MKSALFTRFFILLPWILIVIIMLDVDTRRPVPPLTPRPYFSPYAVGRGGARLPLRRGGPAHGTQKRNQSRPQPQPEPQLPTIYAITPTYSRPVQKAELTRLANTFRQVAQLHWILVEDAAARSELMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVLVWHTRTEKVNLANEPKYHLDTVKIEV

SEQ ID NO: 25038 - protein, 498 aa, Homo sapiens
  ENSP00000343002
MRPPACWWLLAPPALLALLTCSLAFGLASEDTKKEVKQSQDLEKSGISRKNDIDLKGIVFVIQSQSNSFHAKRAEQLKKSILKQAADLTQELPSVLLLHQLAKQEGAWTILPLLPHFSVTYSRNSSWIFFCEEETRIQIPKLLETLRRYDPSKEWFLGKALHDEEATIIHHYAFSENPTVFKYPDFAAGWALSIPLVNKLTKRLKSESLKSDFTIDLKHEIALYIWDKGGGPPLTPVPEFCTNDVDFYCATTFHSFLPLCRKPVKKKDIFVAVKTCKKFHGDRIPIVKQTWESQASLIEYYSDYTENSIPTVDLGIPNTDRGHCGKTFAILERFLNRSQDKTAWLVIVDDDTLISISRLQHLLSCYDSGEPVFLGERYGYGLGTGGYSYITGGGGMVFSREAVRRLLASKCRCYSNDAPDDMVLGMCFSGLGIPVTHSPLFHQARPVDYPKDYLSHQVPISFHKHWNIDPVKVYFTWLAPSDEDKARQETQKGFREEL

SEQ ID NO: 25039 - protein, 378 aa, Homo sapiens
  ENSP00000316173
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 25040 - protein, 62 aa, Homo sapiens
  ENSP00000418785
MRMLVSGRRVKKWQLIIQLFATCFLASLMFFWEPIDNHIVSHMKSYSYRYLINSYDFVNDTL

SEQ ID NO: 25041 - protein, 378 aa, Homo sapiens; identical to SEQ ID NO: 25039
  ENSP00000420778

SEQ ID NO: 25042 - protein, 81 aa, Homo sapiens
  ENSP00000418477
MRMLVSGRRVKKWQLIIQLFATCFLASLMFFWEPIDNHIVSHMKSYSYRYLINSYDFVNDTLSLKHTSAGPRYQYLINHKE

SEQ ID NO: 25043 - protein, 378 aa, Homo sapiens; identical to SEQ ID NO: 25039
  ENSP00000417868

SEQ ID NO: 25044 - protein, 50 aa, Homo sapiens
  ENSP00000417301
MRMLVSGRRVKKWQLIIQLFATCFLASLMFFWEPIDNHIVSHMKSYSYRY

SEQ ID NO: 25045 - protein, 401 aa, Homo sapiens
  ENSP00000287590
MSLWKKTVYRSLCLALALLVAVTVFQRSLTPGQFLQEPPPPTLEPQKAQKPNGQLVNPNNFWKNPKDVAAPTPMASQGPQAWDVTTTNCSANINLTHQPWFQVLEPQFRQFLFYRHCRYFPMLLNHPEKCRGDVYLLVVVKSVITQHDRREAIRQTWGRERQSAGGGRGAVRTLFLLGTASKQEERTHYQQLLAYEDRLYGDILQWGFLDTFFNLTLKEIHFLKWLDIYCPHVPFIFKGDDDVFVNPTNLLEFLADRQPQENLFVGDVLQHARPIRRKDNKYYIPGALYGKASYPPYAGGGGFLMAGSLARRLHHACDTLELYPIDDVFLGMCLEVLGVQPTAHEGFKTFGISRNRNSRMNKEPCFFRAMLVVHKLLPPELLAMWGLVHSNLTCSRKLQVL

SEQ ID NO: 25046 - protein, 382 aa, Homo sapiens
  ENSP00000306459
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 25047 - protein, 343 aa, Homo sapiens
  ENSP00000237019
MSVLRRMMRVSNRSLLAFIFFFSLSSSCLYFIYVAPGIDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 25048 - protein, 343 aa, Homo sapiens
  ENSP00000372613
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 25049 - protein, 71 aa, Homo sapiens
  ENSP00000463961
MVQARGIMLRENVKTIGHMIRLYTNKNSTLNGTDYPEGNNSSDYLVQTTTYLPENFTYSPYLPCPEKLPYM

SEQ ID NO: 25050 - protein, 841 aa, Homo sapiens
  ENSP00000257749
MSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFASTFREDNSSNSLKPGLARGQIKSEPPSEENEEESITLCLSGDEPDAKDRAGDVEMDRKQPSPAPTPTAPAGAACLERSRSVASPSCLRSLFSITKSVELSGLPSTSQQHFARSPACPFDKGITQGDLKTDYTPFTGNYGQPHVGQKEVSNFTMGSPLRGPGLEALCKQEGELDRRSVIFSSSACDQVSTSVHSYSGVSSLDKDLSEPVPKGLWVGAGQSLPSSQAYSHGGLMADHLPGRMRPNTSCPVPIKVCPRSPPLETRTRTSSSCSSYSYAEDGSGGSPCSLPLCEFSSSPCSQGARFLATEHQEPGLMGDGMYNQVRPQIKCEQSYGTNSSDESGSFSEADSESCPVQDRGQEVKLPFPVDQITDLPRNDFQMMIKMHKLTSEQLEFIHDVRRRSKNRIAAQRCRKRKLDCIQNLECEIRKLVCEKEKLLSERNQLKACMGELLDNFSCLSQEVCRDIQSPEQIQALHRYCPVLRPMDLPTASSINPAPLGAEQNIAASQCAVGENVPCCLEPGAAPPGPPWAPSNTSENCTSGRRLEGTDPGTFSERGPPLEPRSQTVTVDFCQEMTDKCTTDEQPRKDYT

SEQ ID NO: 25051 - protein, 841 aa, Homo sapiens; identical to SEQ ID NO: 25050
  ENSP00000345642

SEQ ID NO: 25052 - protein, 81 aa, Homo sapiens
  ENSP00000384145
MSVDEKPDSPMYVYESTVHCTNILLGLNDQRKKDILCDVTLIVERKEFRAHRAVLAACSEYFWQALVGQTKNDLVVSLPEE

SEQ ID NO: 25053 - protein, 81 aa, Homo sapiens; identical to SEQ ID NO: 25052
  ENSP00000397668

SEQ ID NO: 25054 - protein, 841 aa, Homo sapiens; identical to SEQ ID NO: 25050
  ENSP00000437473

SEQ ID NO: 25055 - protein, 168 aa, Homo sapiens
  ENSP00000378040
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 25056 - protein, 168 aa, Homo sapiens; identical to SEQ ID NO: 25055
  ENSP00000309103

SEQ ID NO: 25057 - protein, 157 aa, Homo sapiens
  ENSP00000440575
MFQIPEFEPSEQEDSSSAERGLGPSPAGDGPSGSGKHHRQAPGLLWDASHQQEQPTSSSHHGEGTSSPEERGHSNADAAKLQLDASLPVLVGSELGQGKLRPLPVTFAPHPETPPVPTALGSHLEYGRKYFPQAYAKRGSVLSPLEGGLTQIPFRCV

SEQ ID NO: 25058 - protein, 163 aa, Homo sapiens
  ENSP00000378039
MFQIPEFEPSEQEDSSSAERGLGPSPAGDGPSGSGKHHRQAPGLLWDASHQQEQPTSSSHHGGRTSYSPSWESEDSENPSAGMLAEASAGMSAPAADSEAQHAENVKLEALGLWRSGVATAPTPRGRRTTKGWGRSPAPFGAARARRPPTSGQHSAMAASSGG

SEQ ID NO: 25059 - protein, 64 aa, Homo sapiens
  ENSP00000438975
MGEEPSPFRGRSRSAPPNLWAAQRYGRELRRMSDEFVDSFKKGLPRPKSAGTATQMRQSSSWTR

SEQ ID NO: 25060 - protein, 51 aa, Homo sapiens
  ENSP00000439202
MGEEPSPFRGRSRSAPPNLWAAQRYGRELRRMSDEFVDSFKKGLPRPKSAG

SEQ ID NO: 25061 - protein, 575 aa, Homo sapiens
  ENSP00000358081
MSAATHSPMMQVASGNGDRDPLPPGWEIKIDPQTGWPFFVDHNSRTTTWNDPRVPSEGPKETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQQPMTHRETAPVSQPENKPESKPGPVGPELPPGHIPIQVIRKEVDSKPVSQKPPPPSEKVEVKVPPAPVPCPPPSPGPSAVPSSPKSVATEERAAPSTAPAEATPPKPGEAEAPPKHPGVLKVEAILEKVQGLEQAVDNFEGKKTDKKYLMIEEYLTKELLALDSVDPEGRADVRQARRDGVRKVQTILEKLEQKAIDVPGQVQVYELQPSNLEADQPLQAIMEMGAVAADKGKKNAGNAEDPHTETQQPEATAAATSNPSSMTDTPGNPAAP

SEQ ID NO: 25062 - protein, 325 aa, Homo sapiens
  ENSP00000410036
MQETPSSANGPSREGSRLPPAREGHPVYPQLRPGYIPIPVLHEGAENRQVHPFHVYPQPGMQRFRTEAAAAAPQRSQSPLRGMPETTQPDKQCGQVAAAAAAQPPASHGPERSQSPAASDCSSSSSSASLPSSGRSSLGSHQLPRGYISIPVIHEQNVTRPAAQPSFHQAQKTHYPAQQGEYQTHQPVYHKIQGDDWEPRPLRAASPFRSSVQGASSREGSPARSSTPLHSPSPIRVHTVVDRPQPMTHRETAPVSQPENKPESKPGPVGPELPPGHIPIQVIRKEVDSKPVSQKPPPPSEKVEVKVPPAPVPCPPPSPGPSAVP

SEQ ID NO: 25063 - protein, 521 aa, Homo sapiens
  ENSP00000315685
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 25064 - protein, 106 aa, Homo sapiens
  ENSP00000460344
MSLSRSEEMHRLTENVYKTIMEQFNPSLRNFIAMGKNYEKALAGVTYAAKGYFDALVKMGELASESQGSKELGDVLFQMAEVHRQIQNQLEEMPCPASCSGSMCWS

SEQ ID NO: 25065 - protein, 79 aa, Homo sapiens
  ENSP00000458494
MGELASESQGSKELGDVLFQMAEVHRQIQNQLEEMLKSFHNELLTQLEQKVELDSRYLSAALKKYQTEQRSKGDALDKC

SEQ ID NO: 25066 - protein, 149 aa, Homo sapiens
  ENSP00000460492
MSLSRSEEMHRLTENVYKRVEEKYQRNLFPIFSPSALKPESRNFRGESWQGTIMEQFNPSLRNFIAMGKNYEKALAGVTYAAKGYFDALVKMGELASESQGSKELGDVLFQMAEVHRQIQNQLEEMLKSFHNELLTQLEQKVELDSRLR

SEQ ID NO: 25067 - protein, 534 aa, Homo sapiens
  ENSP00000401022
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 25068 - protein, 512 aa, Homo sapiens
  ENSP00000458964
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSR

SEQ ID NO: 25069 - protein, 553 aa, Homo sapiens
  ENSP00000461144
MSLSRSEEMHRLTENVYKRVEEKYQRNLFPIFSPSALKPESRNFRGESWQGTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 25070 - protein, 520 aa, Homo sapiens
  ENSP00000413069
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 25071 - protein, 552 aa, Homo sapiens
  ENSP00000316338
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRCDLSAQGPEGREHGDGSARTLAGR

SEQ ID NO: 25072 - protein, 140 aa, Homo sapiens
  ENSP00000458202
MEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDK

SEQ ID NO: 25073 - protein, 175 aa, Homo sapiens
  ENSP00000460131
MEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFC

SEQ ID NO: 25074 - protein, 135 aa, Homo sapiens
  ENSP00000458522
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRR

SEQ ID NO: 25075 - protein, 114 aa, Homo sapiens
  ENSP00000461736
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQ

SEQ ID NO: 25076 - protein, 234 aa, Homo sapiens
  ENSP00000459787
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSA

SEQ ID NO: 25077 - protein, 180 aa, Homo sapiens
  ENSP00000458735
MGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPE

SEQ ID NO: 25078 - protein, 58 aa, Homo sapiens
  ENSP00000459730
MGELASESQGSKELGDVLFQMAEVHRQIQNQLEEMLKSFHNELLTQLEQKVELDSRLR

SEQ ID NO: 25079 - protein, 97 aa, Homo sapiens
  ENSP00000461101
QTEQRSKGDALDKCQAELKKLRKKSQGSKNPQKYSDKELQYIDAISNKQGELENYVSDGYKTALTEERRRFCFLVEKQCAVAKNSAAYHSKGGPGPV

SEQ ID NO: 25080 - protein, 130 aa, Homo sapiens
  ENSP00000458440
MQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLER

SEQ ID NO: 25081 - protein, 375 aa, Homo sapiens
  ENSP00000391837
MLLPEGQRQRALGFGTVTSTYSPVGQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSR

SEQ ID NO: 25082 - protein, 216 aa, Homo sapiens
  ENSP00000460350
  MOD_RES (1)..(1): Any amino acid
XPKSLSPPQSQSKLSDSYSNTLPVRKSVTPKNSYATTAENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSRNPFAHVQLKPTVTNDRSAPLLS

SEQ ID NO: 25083 - protein, 260 aa, Homo sapiens
  ENSP00000364683
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 25084 - protein, 327 aa, Homo sapiens
  ENSP00000263610
MEGSNGFGIDSILSHRAGSPALPKGDPLLGDCRSPLELSPRSESSSDCSSPASPGRDCLETGTPRPGGASGPGLDSHLQPGQLSAPAQSRTVTSSFLIRDILADCKPLAACAPYSSSGQPAAPEPGGRLAAKAAEDFRDKLDKSGSNASSDSEYKVKEEGDREISSSRDSPPVRLKKPRKARTAFTDHQLAQLERSFERQKYLSVQDRMELAASLNLTDTQVKTWYQNRRTKWKRQTAVGLELLAEAGNYSALQRMFPSPYFYPQSLVSNLDPGAALYLYRGPSAPPPALQRPLVPRILIHGLQGASEPPPPLPPLAGVLPRAAQPR

SEQ ID NO: 25085 - protein, 327 aa, Homo sapiens; identical to SEQ ID NO: 25084
  ENSP00000444704

SEQ ID NO: 25086 - protein, 387 aa, Homo sapiens
  ENSP00000359474
MTMEGASGSSFGIDTILSSASSGSPGMMNGDFRPLGEARTADFRSQATPSPCSEIDTVGTAPSSPISVTMEPPEPHLVADATQHHHHLHHSQQPPPPAAAPTQSLQPLPQQQQPLPPQQPPPPPPQQLGSAASAPRTSTSSFLIKDILGDSKPLAACAPYSTSVSSPHHTPKQESNAVHESFRPKLEQEDSKTKLDKREDSQSDIKCHGTKEEGDREITSSRESPPVRAKKPRKARTAFSDHQLNQLERSFERQKYLSVQDRMDLAAALNLTDTQVKTWYQNRRTKWKRQTAVGLELLAEAGNYSALQRMFPSPYFYHPSLLGSMDSTTAAAAAAAMYSSMYRTPPAPHPQLQRPLVPRVLIHGLGPGGQPALNPLSSPIPGTPHPR

SEQ ID NO: 25087 - protein, 45 aa, Homo sapiens
  ENSP00000476090
MGGKLSKKKKGYNVNDEKAKEKDKKAEGAATEEEGTPKESEPQAA

SEQ ID NO: 25088 - protein, 227 aa, Homo sapiens
  ENSP00000319281
MGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 25089 - protein, 227 aa, Homo sapiens; identical to SEQ ID NO: 25088
  ENSP00000482066

SEQ ID NO: 25090 - protein, 85 aa, Homo sapiens
  ENSP00000463176
  MOD_RES (1)..(1): Any amino acid
XKTMKSRYMELYDLNRDLLNGYKIRCNNHTELLGNLKAVNQAIQRAGRLRVGKPKNQVITACRDAIRSNNINTLFKIMRVGTASS

SEQ ID NO: 25091 - protein, 142 aa, Homo sapiens
  ENSP00000463731
LQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 25092 - protein, 675 aa, Homo sapiens
  ENSP00000456289
MLLPVFTLKLRHKISPRMVAIGRYDGTHPCLAAATQTGKVFIHNPHTRNQHVSASRVFQSPLESDVSLLSINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 25093 - protein, 721 aa, Homo sapiens
  ENSP00000245157
MLLPVFTLKLRHKISPRMVAIGRYDGTHPCLAAATQTGKVFIHNPHTRNQHVSASRVFQSPLESDVSLLSINQAVSCLTAGVLNPELGYDALLVGTQTNLLAYDVYNNSDLFYREVADGANAIVLGTLGDISSPLAIIGGNCALQGFNHEGSDLFWTVTGDNVNSLALCDFDGDGKKELLVGSEDFDIRVFKEDEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIQLICCSVDGEIRGYLPGTAEMRGNLMDTSAEQDLIRELSQKKQNLLLELRNYEENAKAELASPLNEADGHRGIIPANTRLHTTLSVSLGNETQTAHTELRISTSNDTIIRAVLIFAEGIFTGESHVVHPSIHNLSSSICIPIVPPKDVPVDLHLKAFVGYRSSTQFHVFESTRQLPRFSMYALTSLDPASEPISYVNFTIAERAQRVVVWLGQNFLLPEDTHIQNAPFQVCFTSLRNGGHLHIKIKLSGEITINTDDIDLAGDIIQSMASFFAIEDLQVEADFPVYFEELRKVLVKVDEYHSVHQKLSADMADHSNLIRSLLVGAEDARLMRDMKTMKSRYMELYDLNRDLLNGYKIRCNNHTELLGNLKAVNQAIQRAGRLRVGKPKNQVITACRDAIRSNNINTLFKIMRVGTASS

SEQ ID NO: 25094 - protein, 76 aa, Homo sapiens
  ENSP00000454986
  MOD_RES (1)..(1): Any amino acid
XNLSSSICIPIVPPKDVPVDLHLKAFVGYRSSTQFHVFESTRQLPRFSMYALTSLDPASEPISYVNFTIAERAQRQ

SEQ ID NO: 25095 - protein, 119 aa, Homo sapiens
  ENSP00000455651
DEIVAEMTETEIVTSLCPMYGSRFGYALSNGTVGVYDKTSRYWRIKSKNHAMSIHAFDLNSDGVNELITGWSNGKVDARSDRTGEVIFKDNFSSAIAGVVEGDYRMDGHIHPGLPAWHG

SEQ ID NO: 25096 - protein, 5 aa, Homo sapiens
  ENSP00000456741
MTETE

SEQ ID NO: 25097 - protein, 888 aa, Homo sapiens
  ENSP00000377074
MHCPGEAPLAAPRPTPKDPCLRNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25098 - protein, 870 aa, Homo sapiens
  ENSP00000162330
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25099 - protein, 57 aa, Homo sapiens
  ENSP00000455166
MPAKPFLSSVLLSWKVLDFSGPGPQGTGQPCSCGHWAEGQGGPPEPAGGPVSQGSSD

SEQ ID NO: 25100 - protein, 722 aa, Homo sapiens
  ENSP00000440370
MQGKNVLAKALYDNVAESPDELSFRKGDIMTVLEQDTQGLDGWWLCSLHGRQGIVPGNRLKILVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25101 - protein, 870 aa, Homo sapiens
  ENSP00000443841
MSVPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25102 - protein, 916 aa, Homo sapiens
  ENSP00000391669
MPAKPFLSSVLLSWKVLDFSGPGPQGTGQPCSCGHWAEGQGGPPEPAGGPNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25103 - protein, 868 aa, Homo sapiens
  ENSP00000440415
MENVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25104 - protein, 888 aa, Homo sapiens
  ENSP00000392708
MLTHRPQEAEQRGRTPGPSFEWNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25105 - protein, 888 aa, Homo sapiens
  ENSP00000377072
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVSKCQGNARARLRLWGVWVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 25106 - protein, 238 aa, Homo sapiens
  ENSP00000454702
  MOD_RES (1)..(1): Any amino acid
XPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVY

SEQ ID NO: 25107 - protein, 135 aa, Homo sapiens
  ENSP00000456625
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDL

SEQ ID NO: 25108 - protein, 133 aa, Homo sapiens
  ENSP00000455810
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPAT

SEQ ID NO: 25109 - protein, 128 aa, Homo sapiens
  ENSP00000456929
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPF

SEQ ID NO: 25110 - protein, 120 aa, Homo sapiens
  ENSP00000458088
MTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFS

SEQ ID NO: 25111 - protein, 80 aa, Homo sapiens
  ENSP00000457457
MTVLEQDTQGLDGWWLCSLHGRQGIVPGNRLKILVGMYDKKPAGPGPGPPATPAQPQPGLHAPAPPASQYTPMLPNTYQP

SEQ ID NO: 25112 - protein, 58 aa, Homo sapiens
  ENSP00000457097
MTVLEQDTQGLDGWWLCSLHGRQGIVPGNRLKILVGMYDKKPAGPGPGPPATPAQPQP

SEQ ID NO: 25113 - protein, 50 aa, Homo sapiens
  ENSP00000457231
MTVLEQDTQGLDGWWLCSLHGRQGIVPGNRLKILVGMYDKKPAGPGPGPP

SEQ ID NO: 25114 - protein, 57 aa, Homo sapiens; identical to SEQ ID NO: 25099
  ENSP00000442161

SEQ ID NO: 25115 - protein, 476 aa, Homo sapiens
  ENSP00000396361
TLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTASKAESVCDGQAGQKTSEIQARGTKKKHLDSPRLGLAFRKFFRHKGAEKSPTTSADLKSDKANFTSQETQGAGKNSKGCNPSGHTQSVTTPEPAKEGTKEKSGPTSLPLGKLFWKKVVCESPVEIIKSKEVESALQTVDLNEGDAAPEPTEAKLKREESKPRTSLMAFLRQMTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSKYTGKCVFSHVKKKWPFQEWSY

SEQ ID NO: 25116 - protein, 506 aa, Homo sapiens
  ENSP00000360490
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 25117 - protein, 584 aa, Homo sapiens
  ENSP00000379290
MGNQMSVPQRVEDQENEPEAETYQDNASALNGVPVVVSTHTVQHLEEVDLGISVKTDNVATSSPETTEISAVADANGKNLGKEAKPEAPAAKSRFFLMLSRPVPGRTGDQAADSSLGSVKLDVSSNKAPANKDPSESWTLPVAAGPGQDTDKTPGHAPAQDKVLSAARDPTLLPPETGGAGGEAPSKPKDSSFFDKFFKLDKGQEKVPGDSQQEAKRAEHQDKVDEVPGLSGQSDDVPAGKDIVDGKEKEGQELGTADCSVPGDPEGLETAKDDSQAAAIAENNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENVVCESPVEIIKSKEVESALQTVDLNEGDAAPEPTEAKLKREESKPRTSLMAFLRQMSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 25118 - protein, 247 aa, Homo sapiens
  ENSP00000399936
  MOD_RES (1)..(1): Any amino acid
XNNNSIMSFFKTLVSPNKAETKKDPEDTGAEKSPTTSADLKSDKANFTSQETQGAGKNSKGCNPSGHTQSVTTPEPAKEGTKEKSGPTSLPLGKLFWKKSVKEDSVPTGAEENSVKGDGGITHSEEINGKDSSCQTSDSTEKTITPPEPEPTGAPQKGKEGSSKDKKSAAEMNKQKSNKQEAKEPAQCTEQATVDTNSLQNGDKLQKRPEKRQQSLGGFFKGLGPKRMLDAQVQTDPVSIGPVGKSK

SEQ ID NO: 25119 - protein, 225 aa, Homo sapiens
  ENSP00000358554
MAGTGLVAGEVVVDALPYFDQGYEAPGVREAAAALVEEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQLTAGSKLREMESNWVSLVSKNYEIERTIVQLENEIYQIKQQHGEANKENIRQDF

SEQ ID NO: 25120 - protein, 602 aa, Homo sapiens
  ENSP00000264381
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 25121 - protein, 562 aa, Homo sapiens
  ENSP00000419505
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTG

SEQ ID NO: 25122 - protein, 525 aa, Homo sapiens
  ENSP00000419804
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGCSSSTILNYVLETEPVVLI

SEQ ID NO: 25123 - protein, 132 aa, Homo sapiens
  ENSP00000418325
AVQFTGWSSSCILHFPEVLHDFHSLQTLPSLLQRIGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 25124 - protein, 120 aa, Homo sapiens
  ENSP00000418504
AVQFTGWSSSCILHFPEVLHDFHSLQTLPSLLQRIGNPNETQNNSTSWPVFKSTEQKYLTLNTESTRIMTKLRAQQCRFWTSFFPKVLEMTEPICCYCEPGTALAARAAQMKMTGSAYSQ

SEQ ID NO: 25125 - protein, 773 aa, Homo sapiens
  ENSP00000349300
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCSSHTPIRRSTQRAQDVWQFSDGSSRALKF

SEQ ID NO: 25126 - protein, 243 aa, Homo sapiens
  ENSP00000352648
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 25127 - protein, 191 aa, Homo sapiens
  ENSP00000488390
MNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVLHTPPFGVVPRELKMCGSFRMEAREPLSSEKI

SEQ ID NO: 25128 - protein, 17 aa, Homo sapiens
  ENSP00000488636
  MOD_RES (1)..(1): Any amino acid
XKKWHSDRVLNNDIKTE

SEQ ID NO: 25129 - protein, 167 aa, Homo sapiens
  ENSP00000488886
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAGNPRGSSEKSPGCQCKGPALSPRRPSGKCTGLQLFPRPL

SEQ ID NO: 25130 - protein, 835 aa, Homo sapiens
  ENSP00000338774
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 25131 - protein, 801 aa, Homo sapiens
  ENSP00000351307
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAGKDEPSSYTCTTCKQPFTSAWFLLQHAQNTHGLRIYLESEHGSPLTPRVGIPSGLGAECPSQPPLHGIHIADNNPFNLLRIPGSVSREASGLAEGRFPPTPPLFSPPPRHHLDPHRIERLGAEEMALATHHPSAFDRVLRLNPMAMEPPAMDFSRRLRELAGNTSSPPLSPGRPSPMQRLLQPFQPGSKPPFLATPPLPPLQSAPPPSQPPVKSKSCEFCGKTFKFQSNLVVHRRSHTGEKPYKCNLCDHACTQASKLKRHMKTHMHKSSPMTVKSDDGLSTASSPEPGTSDLVGSASSALKSVVAKFKSENDPNLIPENGDEEEEEDDEEEEEEEEEEEEELTESERVDYGFGLSLEAARHHENSSRGAVVGVGDESRALPDVMQGMVLSSMQHFSEAFHQVLGEKHKRGHLAEAEGHRDTCDEDSVAGESDRIDDGTVNGRGCSPGESASGGLSKKLLLGSPSSLSPFSKRIKLEKEFDLPPAAMPNTENVYSQWLAGYAASRQLKDPFLSFGDSRQSPFASSSEHSSENGSLRFSTPPGELDGGISGRSGTGSGGSTPHISGPGPGRPSSKEGRRSDTCEYCGKVFKNCSNLTVHRRSHTGERPYKCELCNYACAQSSKLTRHMKTHGQVGKDVYKCEICKMPFSVYSTLEKHMKKWHSDRVLNNDIKTE

SEQ ID NO: 25132 - protein, 142 aa, Homo sapiens
  ENSP00000487844
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIAAQTELEDVFVYLMV

SEQ ID NO: 25133 - protein, 894 aa, Homo sapiens
  ENSP00000349723
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGPCRPAQLPAVAPIAASSHPHSSVITSPLRALGALPPCLPLPCCSARPVSGDGTQGEGQTEAPFGCQCQLSGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 25134 - protein, 823 aa, Homo sapiens
  ENSP00000280435
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 25135 - protein, 700 aa, Homo sapiens
  ENSP00000387419
MSRRKQGNPQHLSQRELITRKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 25136 - protein, 894 aa, Homo sapiens; identical to SEQ ID NO: 25133
  ENSP00000349723

SEQ ID NO: 25137 - protein, 823 aa, Homo sapiens; identical to SEQ ID NO: 25134
  ENSP00000280435

SEQ ID NO: 25138 - protein, 700 aa, Homo sapiens; identical to SEQ ID NO: 25135
  ENSP00000387419

SEQ ID NO: 25139 - protein, 247 aa, Homo sapiens
  ENSP00000389345
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 25140 - protein, 247 aa, Homo sapiens; identical to SEQ ID NO: 25139
  ENSP00000437138

SEQ ID NO: 25141 - protein, 262 aa, Homo sapiens
  ENSP00000379309
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 25142 - protein, 247 aa, Homo sapiens; identical to SEQ ID NO: 25139
  ENSP00000432727

SEQ ID NO: 25143 - protein, 247 aa, Homo sapiens; identical to SEQ ID NO: 25139
  ENSP00000349084

SEQ ID NO: 25144 - protein, 247 aa, Homo sapiens; identical to SEQ ID NO: 25139
  ENSP00000400502

SEQ ID NO: 25145 - protein, 247 aa, Homo sapiens; identical to SEQ ID NO: 25139
  ENSP00000432376

SEQ ID NO: 25146 - protein, 247 aa, Homo sapiens; identical to SEQ ID NO: 25139
  ENSP00000435564

SEQ ID NO: 25147 - protein, 77 aa, Homo sapiens
  ENSP00000433003
MCGATSFLHECTRLILVTTQNAEFLQKGLQVHTCFGVYPHASVWHDCASQKKGCAVYLHVSVEFNKLIPENGFIKGW

SEQ ID NO: 25148 - protein, 247 aa, Homo sapiens; identical to SEQ ID NO: 25139
  ENSP00000379307

SEQ ID NO: 25149 - protein, 329 aa, Homo sapiens
  ENSP00000414303
MCGATSFLHECTRLILVTTQNAEFLQKGLQVHTCFGVYPHASVWHDCASQKKGCAVYLHVSVEFNKLIPENGFIKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 25150 - protein, 247 aa, Homo sapiens; identical to SEQ ID NO: 25139
  ENSP00000435805

SEQ ID NO: 25151 - protein, 247 aa, Homo sapiens; identical to SEQ ID NO: 25139
  ENSP00000379305

SEQ ID NO: 25152 - protein, 247 aa, Homo sapiens; identical to SEQ ID NO: 25139
  ENSP00000379302

SEQ ID NO: 25153 - protein, 247 aa, Homo sapiens; identical to SEQ ID NO: 25139
  ENSP00000432035

SEQ ID NO: 25154 - protein, 255 aa, Homo sapiens
  ENSP00000320002
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 25155 - protein, 247 aa, Homo sapiens; identical to SEQ ID NO: 25139
  ENSP00000379304

SEQ ID NO: 25156 - protein, 247 aa, Homo sapiens; identical to SEQ ID NO: 25139
  ENSP00000389564

SEQ ID NO: 25157 - protein, 259 aa, Homo sapiens
  ENSP00000442793
MSFKRPCPLARYNRTSYFYPTFSESSEHSHLLVSPVLVASAVIGVVIILSCITIIVGSIRRDRQARLQRHRHRHHRHHHHHHHHRRRRHREYEHGYVSDEHTYSRSSRRMRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 25158 - protein, 150 aa, Homo sapiens
  ENSP00000456822
MRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 25159 - protein, 150 aa, Homo sapiens; identical to SEQ ID NO: 25158
  ENSP00000299694

SEQ ID NO: 25160 - protein, 208 aa, Homo sapiens
  ENSP00000455212
MRYACSSSEDWPPPLDISSDGDVDATVLRELYPDSPPGVSLSRLRWSAMMYTGSFTYWVRSMLSRHKLDAILGRLGYTATLESEFSLVQAISKENVKQMVFKIFLVRVSCEAVLRTAGTRMLEPGTEKLARTHSRHSSEKRLVKPCSCLEGVQPGPGSGGPQQGPSEGVGSETALAEGTAGQRSLPMALSPSEVSTAPNSLPSGSPVL

SEQ ID NO: 25161 - protein, 113 aa, Homo sapiens
  ENSP00000477843
MSFKRPCPCKFPPHILPPLGARQGQSLESSCRERLEVFGQRTAGVQPEANVACWVGRGQHGRPLTSARCSLRTENRTLAHSSVSALPEVWIGVPLRDVNGMTHTHTQIKDYMA

SEQ ID NO: 25162 - protein, 72 aa, Homo sapiens
  ENSP00000456430
MRYACSSSEDWPPPLDISSDGDVDATVLRELYPDSPPGQGLTQSPTLECNGMNIAHCSLELLGSSDPPTSAS

SEQ ID NO: 25163 - protein, 82 aa, Homo sapiens
  ENSP00000462088
  MOD_RES (1)..(1): Any amino acid
XPLDISSDGDVDATVLRELYPDSPPGCTLGALPTGCDLCFPDTNWTPSWAGWATRPPWSLSSHWSRPSAKRMSSRWCSRSSW

SEQ ID NO: 25164 - protein, 208 aa, Homo sapiens; identical to SEQ ID NO: 25160
  ENSP00000483700

SEQ ID NO: 25165 - protein, 593 aa, Homo sapiens
  ENSP00000411124
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 25166 - protein, 169 aa, Homo sapiens
  ENSP00000451125
MWTGGRRPGRLRRAASAADMEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDF

SEQ ID NO: 25167 - protein, 167 aa, Homo sapiens
  ENSP00000450722
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPS

SEQ ID NO: 25168 - protein, 174 aa, Homo sapiens
  ENSP00000452607
MALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEE

SEQ ID NO: 25169 - protein, 287 aa, Homo sapiens
  ENSP00000452157
MEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAF

SEQ ID NO: 25170 - protein, 299 aa, Homo sapiens
  ENSP00000451397
MPSPSDCASAADMEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAF

SEQ ID NO: 25171 - protein, 812 aa, Homo sapiens
  ENSP00000490571
MLSGASSQARGSNPTCPRQDGYSSLLEPGTEAPIKEAHRQDLRSHMPSPSQGRNPKGKASCHRWAARSSQEMARVSPAQPSSPESLNTGSRAVTGSLARLGRWREARLPFSRFLDEVTVRVLDPGTLEAFRVPRGRSPEPSAVDRGQGLAQEALTRAAAPGEKDPALSSQLSSEAATEAASRVGPGQAVGTSGPCLGSGKRGGRTASPWRSPGRASAADMEKLSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 25172 - protein, 593 aa, Homo sapiens; identical to SEQ ID NO: 25165
  ENSP00000347301

SEQ ID NO: 25173 - protein, 623 aa, Homo sapiens
  ENSP00000489826
MEKLRLRSPWVPLCLGQPRVLQGRLARSSPSIWDSALQEQKGELRKRLSYTTHKLEKLETEFDSTRHYLEIELRRAQEELEKVTEKLRRIQSNYMALQRINQELEDKLYRMGQHYEEEKRALSHEIVALNSHLLEAKVTIDKLSEDNELYRKDCNLAAQLLQCSQTYGRVHKVSELPSDFQERVSLHMEKHGCSLPSPLCHPAYADSVPTCVIAKVLEKPDPASLSSRLSDASARDLAFCDGVEKPGPRPPYKGDIYCSDTALYCPEERRRDRRPSVDAPVTDVGFLRAQNSTDSAAEEEEEAEAAAFPAGFQHEAFPSYAGSLPTSSSYSSFSATSEEKEHAQASTLTASQQAIYLNSRDELFDRKPPATTYEGSPRFAKATAAVAAPLEAEVAPGFGRTMSPYPAETFRFPASPGPQQALMPPNLWSLRAKPGTARLPGEDMRGQWRPLSVEDIGAYSYPVSAAGRASPCSFSERYYGGAGGSPGKKADGRASPLYASYKADSFSEGDDLSQGHLAEPCFLRAGGDLSLSPGRSADPLPGYAPSEGGDGDRLGVQLCGTASSPEPEQGSRDSLEPSSMEASPEMHPAARLSPQQAFPRTGGSGLSRKDSLTKAQLYGTLLN

SEQ ID NO: 25174 - protein, 143 aa, Homo sapiens
  ENSP00000449868
MRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQLWTKCT

SEQ ID NO: 25175 - protein, 398 aa, Homo sapiens
  ENSP00000329064
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGKQMPKNEWKMEDIKIPLPQPQFQCAKSDPGG

SEQ ID NO: 25176 - protein, 455 aa, Homo sapiens
  ENSP00000433213
MTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 25177 - protein, 668 aa, Homo sapiens
  ENSP00000332413
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 25178 - protein, 562 aa, Homo sapiens
  ENSP00000449548
MFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 25179 - protein, 197 aa, Homo sapiens
  ENSP00000434713
MTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVSLLAVDEMHMSLPKMKKDIYWDDSAARPPYTLAAADYCIPSFLGSTVQMGRSRFNPVPFAECLLIPISDGLWHFSSKGASEAENLSRPKEKED

SEQ ID NO: 25180 - protein, 161 aa, Homo sapiens
  ENSP00000447689
MFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVAEQLINPFGEDDDDFETNWCIDRNLQVS

SEQ ID NO: 25181 - protein, 142 aa, Homo sapiens
  ENSP00000446575
MTVTYSSKVANATFFGFHRLLLKWRGSIYKLLYREFIVFAVLYTAISLVYRLLLTGVQKRYFEKLSIYCDRYAEQIPVTFVLGFMTTDERKLFNHLKSPHLKYWVPFIWFGNLATKARNEGRIRDSVDLQSLMTEMNRYRSW

SEQ ID NO: 25182 - protein, 72 aa, Homo sapiens
  ENSP00000266661
MFLISSSVHGSDEHGRLLRRTLMRYVNLTSLLIFRSVSTAVYKRFPTMDHVVEAERTGMKPILPSSFEMQSF

SEQ ID NO: 25183 - protein, 72 aa, Homo sapiens; identical to SEQ ID NO: 25182
  ENSP00000449377

SEQ ID NO: 25184 - protein, 368 aa, Homo sapiens
  ENSP00000327336
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 25185 - protein, 238 aa, Homo sapiens
  ENSP00000402525
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYVRSWEEPAGLQQRAGVRALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLT

SEQ ID NO: 25186 - protein, 381 aa, Homo sapiens
  ENSP00000318799
MERGMHLGAAAAGEDDLFLHKSLSASTSKRLEAAFRSTPPGMDLSLAPPPRERPASSSSSPLGCFEPADPEGAGLLLPPPGGGGGGSAGSGGGGGGGVGVPGLLVGSAGVGGDPSLSSLPAGAALCLKYGESASRGSVAESSGGEQSPDDDSDGRCELVLRAGVADPRASPGAGGGGAKAAEGCSNAHLHGGASVPPGGLGGGGGGGSSSGSSGGGGGSGSGSGGSSSSSSSSSKKSKEQKALRLNINARERRRMHDLNDALDELRAVIPYAHSPSVRKLSKIATLLLAKNYILMQAQALEEMRRLVAYLNQGQAISAASLPSSAAAAAAAAALHPALGAYEQAAGYPFSAGLPPAASCPEKCALFNSVSSSLCKQCTEKP

SEQ ID NO: 25187 - protein, 412 aa, Homo sapiens
  ENSP00000256495
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 25188 - protein, 93 aa, Homo sapiens
  ENSP00000448933
MAAEEVLQTVDHYKTEIERLTKELTETTHEKIQAAEYGLVVLEEKLTLKQQYDELEAEYDSLKQELEQLKEVSCLSPLPFLALTPPTRKAHSS

SEQ ID NO: 25189 - protein, 79 aa, Homo sapiens
  ENSP00000447663
MAAEEVLQTVDHYKTEIERLTKELTETTHEKIQAAEYGLVVLEEKLTLKQQYDELEAEYDSLKQELEQLKEGPLLVRED

SEQ ID NO: 25190 - protein, 835 aa, Homo sapiens
  ENSP00000446793
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKIVSSLLPPYRHSAHN

SEQ ID NO: 25191 - protein, 975 aa, Homo sapiens
  ENSP00000281474
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRQFSPSLCDQSRPRTSGASYLQNLLRVPPDPTSTESFLLKGPPSMSEFIQGHRLSKEKRLTVAPPDCQQPAASVPPQCSQLAGRQDCPTVSPDTALPEEQPHSSSQCAPLHCLSKPPHP

SEQ ID NO: 25192 - protein, 827 aa, Homo sapiens
  ENSP00000379107
MAAEEVLQTVDHYKTEIERLTKELTETTHEKIQAAEYGLVVLEEKLTLKQQYDELEAEYDSLKQELEQLKEAFGQSFSIHRKVAEDGETREETLLQESASKEAYYLGKILEMQNELKQSRAVVTNVQAENERLTAVVQDLKENNEMVELQRIRMKDEIREYKFREARLLQDYTELEEENITLQKLVSTLKQNQVEYEGLKHEIKRFEEETVLLNSQLEDAIRLKEIAEHQLEEALETLKNEREQKNNLRKELSQYISLNDNHISISVDGLKFAEDGSEPNNDDKMNGHIHGPLVKLNGDYRTPTLRKGESLNPVSDLFSELNISEIQKLKQQLMQVEREKAILLANLQESQTQLEHTKGALTEQHERVHRLTEHVNAMRGLQSSKELKAELDGEKGRDSGEEAHDYEVDINGLEILECKYRVAVTEVIDLKAEIKALKEKYNKSVENYTDEKAKYESKIQMYDEQVTSLEKTTKESGEKMAHMEKELQKMTSIANENHSTLNTAQDELVTFSEELAQLYHHVCLCNNETPNRVMLDYYRQSRVTRSGSLKGPDDPRGLLSPRLARRGVSSPVETRTSSEPVAKESTEASKEPSPTKTPTISPVITAPPSSPVLDTSDIRKEPMNIYNLNAIIRDQIKHLQKAVDRSLQLSRQRAAARELAPMIDKDKEALMEEILKLKSLLSTKREQIATLRAVLKANKQTAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKTIFTFPL

SEQ ID NO: 25193 - protein, 93 aa, Homo sapiens
  ENSP00000447238
MAAEEVLQTVDHYKTEIERLTKELTETTHEKIQAAEYGLVVLEEKLTLKQQYDELEAEYDSLKQELEQLKEGPLLLKDVIYDILNQLAFQFSV

SEQ ID NO: 25194 - protein, 69 aa, Homo sapiens
  ENSP00000475837
  MOD_RES (1)..(1): Any amino acid
XSRQRAAARELAPMIDKDKEALMEEILKLKSLLSTKREQIATLRAVLKANKQAQCLLMKSVNAYEAPSI

SEQ ID NO: 25195 - protein, 173 aa, Homo sapiens
  ENSP00000481877
  MOD_RES (1)..(1): Any amino acid
XAEVALANLKNKYENEKAMVTETMTKLRNELKALKEDAATFSSLRAMFATRCDEYVTQLDEMQRQLAAAEDEKKTLNTLLRMAIQQKLALTQRLEDLEFDHEQSRRSKGKLGKSKIGSPKVSGEASVTVPTIDTYLLHSQGPQTPNIRVSSGTQRKRYACSDLHSTVQWPDFS

SEQ ID NO: 25196 - protein, 855 aa, Homo sapiens
  ENSP00000349351
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSVSHTCACASDRAEGTGLANQVFCSEKHSIYCD

SEQ ID NO: 25197 - protein, 824 aa, Homo sapiens
  ENSP00000364662
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSL

SEQ ID NO: 25198 - protein, 1417 aa, Homo sapiens
  ENSP00000347232
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 25199 - protein, 1286 aa, Homo sapiens
  ENSP00000454158
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 25200 - protein, 413 aa, Homo sapiens
  ENSP00000453359
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDGSHCVAQAGLELLDLSNPPALASPKGWDYSHEPPCLAKTFFFFPQRKILTT

SEQ ID NO: 25201 - protein, 456 aa, Homo sapiens
  ENSP00000224337
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 25202 - protein, 433 aa, Homo sapiens
  ENSP00000360218
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKDGSFLIRKSSGHDSKQPYTLVVFFNKRVYNIPVRFIEATKQYALGRKKNGEEYFGSVAEIIRNHQHSPLVLIDSQNNTKDSTRLKYAVKVS

SEQ ID NO: 25203 - protein, 121 aa, Homo sapiens
  ENSP00000466331
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIG

SEQ ID NO: 25204 - protein, 65 aa, Homo sapiens
  ENSP00000465741
MDKLNKITVPASQKLRQLQKMVHDIKNNEGGIMNKIKKLKVKAPPSVPRRDYASDTCSLSWNPSK

SEQ ID NO: 25205 - protein, 299 aa, Homo sapiens
  ENSP00000391924
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 25206 - protein, 404 aa, Homo sapiens
  ENSP00000397487
MDKLNKITVPASQKLRQLQKMVHDIKNNEGGIMNKIKKLKVKAPPSVPRRDYASESPADEEEQWSDDFDSDYENPDEHSDSEMYVMPAEENADDSYEPPPVEQETRPVHPALPFARGEYIDNRSSQRHSPPFSKTLPSKPSWPSEKARLTSTLPALTALQKPQVPPKPKGLLEDEADYVVPVEDNDENYIHPTESSSPPPEKAPMVNRSTKPNSSTPASPPGTASGRNSGAWETKSPPPAAPSPLPRAGKKPTTPLKTTPVASQQNASSVCEEKPIPAERHRGSSHRQEAVQSPVFPPAQKQIHQKPIPLPRFTEGGNPTVDGPLPSFSSNSTISEQEAGVLCKPWYAGACDRKSAEEALHRSNKYFGSVAEIIRNHQHSPLVLIDSQNNTKDSTRLKYAVKVS

SEQ ID NO: 25207 - protein, 355 aa, Homo sapiens
  ENSP00000373662
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINKCCKQLLRHGALLTEILLFLQLFLNR

SEQ ID NO: 25208 - protein, 662 aa, Homo sapiens
  ENSP00000421768
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSSKGHLKAYFASQ

SEQ ID NO: 25209 - protein, 854 aa, Homo sapiens
  ENSP00000424668
  MOD_RES (1)..(1): Any amino acid
XFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 25210 - protein, 1161 aa, Homo sapiens
  ENSP00000334836
MKKFSRMPKSEGGSGGGAAGGGAGGAGAGAGCGSGGSSVGVRVFAVGRHQVTLEESLAEGGFSTVFLVRTHGGIRCALKRMYVNNMPDLNVCKREITIMKELSGHKNIVGYLDCAVNSISDNVWEVLILMEYCRAGQVVNQMNKKLQTGFTEPEVLQIFCDTCEAVARLHQCKTPIIHRDLKVENILLNDGGNYVLCDFGSATNKFLNPQKDGVNVVEEEIKKYTTLSYRAPEMINLYGGKPITTKADIWALGCLLYKLCFFTLPFGESQVAICDGNFTIPDNSRYSRNIHCLIRFMLEPDPEHRPDIFQVSYFAFKFAKKDCPVSNINNSSIPSALPEPMTASEAAARKSQIKARITDTIGPTETSIAPRQRPKANSATTATPSVLTIQSSATPVKVLAPGEFGNHRPKGALRPGNGPEILLGQGPPQQPPQQHRVLQQLQQGDWRLQQLHLQHRHPHQQQQQQQQQQQQQQQQQQQQQQQQQQQHHHHHHHHLLQDAYMQQYQHATQQQQMLQQQFLMHSVYQPQPSASQYPTMMPQYQQAFFQQQMLAQHQPSQQQASPEYLTSPQEFSPALVSYTSSLPAQVGTIMDSSYSANRSVADKEAIANFTNQKNISNPPDMSGWNPFGEDNFSKLTEEELLDREFDLLRSNRLEERASSDKNVDSLSAPHNHPPEDPFGSVPFISHSGSPEKKAEHSSINQENGTANPIKNGKTSPASKDQRTGKKTSVQGQVQKGNDESESDFESDPPSPKSSEEEEQDDEEVLQGEQGDFNDDDTEPENLGHRPLLMDSEDEEEEEKHSSDSDYEQAKAKYSDMSSVYRDRSGSGPTQDLNTILLTSAQLSSDVAVETPKQEFDVFGAVPFFAVRAQQPQQEKNEKNLPQHRFPAAGLEQEEFDVFTKAPFSKKVNVQECHAVGPEAHTIPGYPKSVDVFGSTPFQPFLTSTSKSESNEDLFGLVPFDEITGSQQQKVKQRSLQKLSSRQRRTKQDMSKSNGKRHHGTPTSTKKTLKPTYRTPERARRHKKVGRRDSQSSNEFLTISDSKENISVALTDGKDRGNVLQPEESLLDPFGAKPFHSPDLSWHPPHQGLSDIRADHNTVLPGRPRQNSLHGSFHSADVLKMDDFGAVPFTELVVQSITPHQSQQSQPVELDPFGAAPFPSKQ

SEQ ID NO: 25211 - protein, 355 aa, Homo sapiens; identical to SEQ ID NO: 25207
  ENSP00000487317

SEQ ID NO: 25212 - protein, 472 aa, Homo sapiens
  ENSP00000282701
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 25213 - protein, 90 aa, Homo sapiens
  ENSP00000398835
MLWFSGVGALAERYCRRSPGITCCVLLLLNCSGVPMSLASSFLTGSVAKCENEGEVLQIPFITDNPCIMCVCLHEPTRWSNLTQNPGFYD

SEQ ID NO: 25214 - protein, 685 aa, Homo sapiens
  ENSP00000297161
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKGCTYEGNTYNSSFKWQSPAEPCVLRQCQEGVVTESGVRCVVHCKNPLEHLGMCCPTCPGCVFEGVQYQEGEEFQPEGSKCTKCSCTGGRTQCVREVCPILSCPQHLSHIPPGQCCPKCLGQRKVFDLPFGSCLFRSDVYDNGSSFLYDNCTACTCRDSTVVCKRKCSHPGGCDQGQEGCCEECLLRVPPEDIKVCKFGNKIFQDGEMWSSINCTICACVKGRTECRNKQCIPISSCPQGKILNRKGCCPICTEKPGVCTVFGDPHYNTFDGRTFNFQGTCQYVLTKDCSSPASPFQVLVKNDARRTRSFSWTKSVELVLGESRVSLQQHLTVRWNGSRIALPCRAPHFHIDLDGYLLKVTTKAGLEISWDGDSFVEVMAAPHLKGKLCGLCGNYNGHKRDDLIGGDGNFKFDVDDFAESWRVESNEFCNRPQRKPVPELCQGTVKVKLRAHRECQKLKSWEFQTCHSTVDYATFYRSCVTDMCECPVHKNCYCESFLAYTRACQREGIKVHWEPQQNCAATQCKHGAVYDTCGPGCIKTCDNWNEIGPCNKPCVAGCHCPANLVLHKGRCIKPVLCPQR

SEQ ID NO: 25215 - protein, 161 aa, Homo sapiens
  ENSP00000399843
MLWFSGVGALAERYCRRSPGITCCVLLLLNCSGVPMSLASSFLTGSVAKCENEGEVLQIPFITDNPCIMCVCLVAPMKEIPITAPSNGRARLSLVFYASARRALSQSLGCAVLFIVKTLWSIWECAAPHVQAVCLRVCSIKKGRNFSQKEANVPSVPALEA

SEQ ID NO: 25216 - protein, 133 aa, Homo sapiens
  ENSP00000409998
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKVLVSRVLRDTVLFTLKYWRLPVFWLHL

SEQ ID NO: 25217 - protein, 1099 aa, Homo sapiens
  ENSP00000370047
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 25218 - protein, 903 aa, Homo sapiens
  ENSP00000431516
MAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRYWEKSNEQNGLLVSWGETLSSLK

SEQ ID NO: 25219 - protein, 327 aa, Homo sapiens
  ENSP00000392212
PSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLRRGNSNRPGTCCLHTGDSLEESVIVRISCKRLES

SEQ ID NO: 25220 - protein, 860 aa, Homo sapiens
  ENSP00000408370
SEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLLPT

SEQ ID NO: 25221 - protein, 1032 aa, Homo sapiens
  ENSP00000370042
MAHLGPTPPPHSLNYKSEDRLSEQDWPAYFKVPCCGVDTSQIEAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRHSANINLHRKLLTKELDDMGLDSSQPSLSKDLRDEFLVKIYGAQHPMGLDVREDASSPAGTEDSHLNGYGRGMAEDYMVLDLSTTSSLQSSSSIHSSRESDAGSDEGILLDDIDGASDSGESAHKAEAPALPGSLGAEVSGSLMFSSLSGSNGGIMCNICHKMYSNKGTLRVHYKTVHLREMHKCKVPGCNMMFSSVRSRNRHSQNPNLHKNIPFTSVD

SEQ ID NO: 25222 - protein, 294 aa, Homo sapiens
  ENSP00000370041
MQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVS

SEQ ID NO: 25223 - protein, 245 aa, Homo sapiens
  ENSP00000474045
MQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLL

SEQ ID NO: 25224 - protein, 164 aa, Homo sapiens
  ENSP00000474647
MSEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHIL

SEQ ID NO: 25225 - protein, 121 aa, Homo sapiens
  ENSP00000473935
MQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQ

SEQ ID NO: 25226 - protein, 109 aa, Homo sapiens
  ENSP00000474468
SEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHETLKSCLQ

SEQ ID NO: 25227 - protein, 43 aa, Homo sapiens
  ENSP00000474832
MAIRCTLVNCTCECFQPGKINLRTCDQCKHGWVAHETLKSCLQ

SEQ ID NO: 25228 - protein, 40 aa, Homo sapiens
  ENSP00000477717
MQFGTRTTTAEPGFMGTWQNADTNLLFRMSQQAIRCTLVN

SEQ ID NO: 25229 - protein, 40 aa, Homo sapiens; identical to SEQ ID NO: 25228
  ENSP00000482793

SEQ ID NO: 25230 - protein, 729 aa, Homo sapiens
  ENSP00000444640
MLYGTQAVPVRLKILLDRLFSVLKQEEVLHILHGLGWTLRDYVRGYILQDAAGKVLDRWAIMSREEEIITLQQFLRFGETKSIVELMAIQEKEGQAVAVPSSKTDSDIRTFIESNNRTRSPSLLAHLENSNPSSIHHFENIPNSLAFLLPFQYINPVSAPLLGLPPNGLLLEQPGLRLREPSLSTQNEYNESSESEVSPTPYKNDQTPNRNALTSITNVEPKTEPACVSPIQNSAPVSDLTKTEHPKSSFRIHRMRRMGSASRKGRVFCNACGKTFYDKGTLKIHYNAVHLKIKHRCTIEGCNMVFSSLRSRNRHSANPNPRLHMPMLRNNRDKDLIRATSGAATPVIASTKSNLALTSPGRPPMGFTTPPLDPVLQNPLPSQLVFSGLKTVQPVPPFYRSLLTPGEMVSPPTSLPTSPIIPTSGTIEQHPPPPSEPVVPAVMMATHEPSADLAPKKKPRKSSMPVKIEKEIIDTADEFDDEDDDPNDGGAVVNDMSHDNHCHSQEEMSPGMSVKDFSKHNRTRCISRTEIRRADSMTSEDQEPERDYENESESSEPKLGEESMEGDEHIHSEVSEKVLMNSERPDENHSEPSHQDVIKVKEEFTDPTYDMFYMSQYGLYNGGGASMAALHESFTSSLNYGSPQKFSPEGDLCSSPDPKICYVCKKSFKSSYSVKLHYRNVHLKEMHVCTVAGCNAAFPSRRSRDRNRNLRMERTIGPGHRDSLHLLPT

SEQ ID NO: 25231 - protein, 84 aa, Homo sapiens
  ENSP00000417362
MLRGTMTAWRGMRPEVTLACLLLATAGCFADLNEVPQVTVQPASTVQKPGGTVILGCVVEPPRMNVTWRLNGKELNGSDDALGV

SEQ ID NO: 25232 - protein, 1114 aa, Homo sapiens
  ENSP00000418663
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 25233 - protein, 65 aa, Homo sapiens
  ENSP00000419022
MTHEVLSTFIPSEGSSSKVEEVDLQDFKLDVQHVIEVDEGNTAVIACHLPESHPKAQVRYSVKQE

SEQ ID NO: 25234 - protein, 157 aa, Homo sapiens
  ENSP00000420154
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLASESAPLPPCHGAVPPHLSHPEAPTIHAASCYS

SEQ ID NO: 25235 - protein, 21 aa, Homo sapiens
  ENSP00000418118
MLRGTMTAWRGMRPEVTLACL

SEQ ID NO: 25236 - protein, 1115 aa, Homo sapiens
  ENSP00000273395
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKQVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 25237 - protein, 32 aa, Homo sapiens
  ENSP00000418260
MLRGTMTAWRGMRPEVTLACLLLATAGCFADL

SEQ ID NO: 25238 - protein, 157 aa, Homo sapiens; identical to SEQ ID NO: 25234
  ENSP00000417337

SEQ ID NO: 25239 - protein, 84 aa, Homo sapiens
  ENSP00000420056
  MOD_RES (1)..(1): Any amino acid
XRACANGIHMNRGCPSAAVGYPGMKPQQHCPGELQQQSDTSSLLRQTHLGNGYDPQSHQITSCCSPITTAANARSSLLLWASQG

SEQ ID NO: 25240 - protein, 39 aa, Homo sapiens
  ENSP00000418182
  MOD_RES (1)..(1): Any amino acid
XQQQSDTSSLLRQTHLGNGYDPQSHQITRAPMLLGPCAS

SEQ ID NO: 25241 - protein, 1114 aa, Homo sapiens; identical to SEQ ID NO: 25232
  ENSP00000347546

SEQ ID NO: 25242 - protein, 783 aa, Homo sapiens
  ENSP00000354481
MRWQCGTRFRGLRPAVAPWTALLALGLPGWVLAVSATAAAVVPEQHASVAGQHPLDWLLTDRGPFHRAQEYADFMERYRQGFTTRYRIYREFARWKVNNLALERKDFFSLPLPLAPEFIRNIRLLGRRPNLQQVTENLIKKYGTHFLLSATLGGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 25243 - protein, 766 aa, Homo sapiens
  ENSP00000356432
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWERTKLDLPLQCYNWTLTLGNKWKTFFETVHIYLRSRIKSNGPNGNESIYYEPLEFIDPSRNLGYMKINNIQVFGYSMHFDPEAIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 25244 - protein, 158 aa, Homo sapiens
  ENSP00000487601
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSK

SEQ ID NO: 25245 - protein, 28 aa, Homo sapiens
  ENSP00000393441
MIWRSRAGAELFSLMALWEWIALSLHCW

SEQ ID NO: 25246 - protein, 176 aa, Homo sapiens
  ENSP00000473664
MGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 25247 - protein, 205 aa, Homo sapiens
  ENSP00000344707
MKQSDASPQERVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 25248 - protein, 385 aa, Homo sapiens
  ENSP00000333769
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 25249 - protein, 160 aa, Homo sapiens
  ENSP00000458665
MAAALFVLLGFALLGTHGASGAEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSE

SEQ ID NO: 25250 - protein, 269 aa, Homo sapiens
  ENSP00000343809
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 25251 - protein, 221 aa, Homo sapiens
  ENSP00000484849
MAAALFVLLGFALLGTHGASGAVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVT

SEQ ID NO: 25252 - protein, 189 aa, Homo sapiens
  ENSP00000478958
MAAALFVLLGFALLGTHGASGAGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 25253 - protein, 55 aa, Homo sapiens
  ENSP00000484624
MAAALFVLLGFALLGTHGASGAAGTVFTTVEDLGSKILLTCSLNDSATEQRAAPE

SEQ ID NO: 25254 - protein, 84 aa, Homo sapiens
  ENSP00000473393
MGTANIQLHGPPRVKAVKSSEHINEGETAMLVCKSESVPPVTDWAWYKITDSEDKALMNGSESRFFVSSSQGRSELHIENLNME

SEQ ID NO: 25255 - protein, 52 aa, Homo sapiens
  ENSP00000473528
MGTANIQLHGPPRVKAVKSSEHINEGETAMLVCKSESVPPVTDWAWYKITDS

SEQ ID NO: 25256 - protein, 3926 aa, Homo sapiens
  ENSP00000296452
MGNEVSLEGGAGDGPLPPGGAGPGPGPGPGPGAGKPPSAPAGGGQLPAAGAARSTAVPPVPGPGPGPGPGPGPGSTSRRLDPKEPLGNQRAASPTPKQASATTPGHESPRETRAQGPAGQEADGPRRTLQVDSRTQRSGRSPSVSPDRGSTPTSPYSVPQIAPLPSSTLCPICKTSDLTSTPSQPNFNTCTQCHNKVCNQCGFNPNPHLTQVKEWLCLNCQMQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRFEKKKPDPLEIGYQAHLPPESLSQLVSRQPPKSPQVLYSPVSPLSPHRLLDTSFASSERLNKAHVSPQKHFTADSALRQQTLPRPMKTLQRSLSDPKPLSPTAEESAKERFSLYQHQGGLGSQVSALPPNSLVRKVKRTLPSPPPEEAHLPLAGQASPQLYAASLLQRGLTGPTTVPATKASLLRELDRDLRLVEHESTKLRKKQAELDEEEKEIDAKLKYLELGITQRKESLAKDRGGRDYPPLRGLGEHRDYLSDSELNQLRLQGCTTPAGQFVDFPATAAAPATPSGPTAFQQPRFQPPAPQYSAGSGGPTQNGFPAHQAPTYPGPSTYPAPAFPPGASYPAEPGLPNQQAFRPTGHYAGQTPMPTTQSTLFPVPADSRAPLQKPRQTSLADLEQKVPTNYEVIASPVVPMSSAPSETSYSGPAVSSGYEQGKVPEVPRAGDRGSVSQSPAPTYPSDSHYTSLEQNVPRNYVMIDDISELTKDSTSTAPDSQRLEPLGPGSSGRPGKEPGEPGVLDGPTLPCCYARGEEESEEDSYDPRGKGGHLRSMESNGRPASTHYYGDSDYRHGARVEKYGPGPMGPKHPSKSLAPAAISSKRSKHRKQGMEQKISKFSPIEEAKDVESDLASYPPPAVSSSLVSRGRKFQDEITYGLKKNVYEQQKYYGMSSRDAVEDDRIYGGSSRSRAPSAYSGEKLSSHDFSGWGKGYEREREAVERLQKAGPKPSSLSMAHSRVRPPMRSQASEEESPVSPLGRPRPAGGPLPPGGDTCPQFCSSHSMPDVQEHVKDGPRAHAYKREEGYILDDSHCVVSDSEAYHLGQEETDWFDKPRDARSDRFRHHGGHAVSSSSQKRGPARHSYHDYDEPPEEGLWPHDEGGPGRHASAKEHRHGDHGRHSGRHTGEEPGRRAAKPHARDLGRHEARPHSQPSSAPAMPKKGQPGYPSSAEYSQPSRASSAYHHASDSKKGSRQAHSGPAALQSKAEPQAQPQLQGRQAAPGPQQSQSPSSRQIPSGAASRQPQTQQQQQGLGLQPPQQALTQARLQQQSQPTTRGSAPAASQPAGKPQPGPSTATGPQPAGPPRAEQTNGSKGTAKAPQQGRAPQAQPAPGPGPAGVKAGARPGGTPGAPAGQPGADGESVFSKILPGGAAEQAGKLTEAVSAFGKKFSSFW

SEQ ID NO: 25257 - protein, 1849 aa, Homo sapiens
  ENSP00000265990
MAVSRLDRLFILLDTGTTPVTRKAAAQQLGEVVKLHPHELNNLLSKVLIYLRSANWDTRIAAGQAVEAIVKNVPEWNPVPRTRQEPTSESSMEDSPTTERLNFDRFDICRLLQHGASLLGSAGAEFEVQDEKSGEVDPKERIARQRKLLQKKLGLNMGEAIGMSTEELFNDEDLDYTPTSASFVNKQPTLQAAELIDSEFRAGMSNRQKNKAKRMAKLFAKQRSRDAVETNEKSNDSTDGEPEEKRRKIANVVINQSANDSKVLIDNIPDSSSLIEETNEWPLESFCEELCNDLFNPSWEVRHGAGTGLREILKAHGKSGGKMGDSTLEEMIQQHQEWLEDLVIRLLCVFALDRFGDFVSDEVVAPVRETCAQTLGVVLKHMNETGVHKTVDVLLKLLTQEQWEVRHGGLLGIKYALAVRQDVINTLLPKVLTRIIEGLQDLDDDVRAVAAASLVPVVESLVYLQTQKVPFIINTLWDALLELDDLTASTNSIMTLLSSLLTYPQVQQCSIQQSLTVLVPRVWPFLHHTISSVRRAALETLFTLLSTQDQNSSSWLIPILPDMLRHIFQFCVLESSQEILDLIHKVWMELLSKASVQYVVAAACPWMGAWLCLMMQPSHLPIDLNMLLEVKARAKEKTGGKVRQGQSQNKEVLQEYIAGADTIMEDPATRDFVVMRARMMAAKLLGALCCCICDPGVNVVTQEIKPAESLGQLLLFHLNSKSALQRISVALVICEWAALQKECKAVTLAVQPRLLDILSEHLYYDEIAVPFTRMQNECKQLISSLADVHIEVGNRVNNNVLTIDQASDLVTTVFNEATSSFDLNPQVLQQLDSKRQQVQMTVTETNQEWQVLQLRVHTFAACAVVSLQQLPEKLNPIIKPLMETIKKEENTLVQNYAAQCIAKLLQQCTTRTPCPNSKIIKNLCSSLCVDPYLTPCVTCPVPTQSGQENSKGSTSEKDGMHHTVTKHRGIITLYRHQKAAFAITSRRGPTPKAVKAQIADLPAGSSGNILVELDEAQKPYLVQRRGAEFALTTIVKHFGGEMAVKLPHLWDAMVGPLRNTIDINNFDGKSLLDKGDSPAQELVNSLQVFETAAASMDSELHPLLVQHLPHLYMCLQYPSTAVRHMAARCVGVMSKIATMETMNIFLEKVLPWLGAIDDSVKQEGAIEALACVMEQLDVGIVPYIVLLVVPVLGRMSDQTDSVRFMATQCFATLIRLMPLEAGIPDPPNMSAELIQLKAKERHFLEQLLDGKKLENYKIPVPINAELRKYQQDGVNWLAFLNKYKLHGILCDDMGLGKTLQSICILAGDHCHRAQEYARSKLAECMPLPSLVVCPPTLTGHWVDEVGKFCSREYLNPLHYTGPPTERIRLQHQVKRHNLIVASYDVVRNDIDFFRNIKFNYCILDEGHVIKNGKTKLSKAVKQLTANYRIILSGTPIQNNVLELWSLFDFLMPGFLGTERQFAARYGKPILASRDARSSSREQEAGVLAMDALHRQVLPFLLRRMKEDVLQDLPPKIIQDYYCTLSPLQVQLYEDFAKSRAKCDVDETVSSATLSEETEKPKLKATGHVFQALQYLRKLCNHPALVLTPQHPEFKTTAEKLAVQNSSLHDIQHAPKLSALKQLLLDCGLGNGSTSESGTESVVAQHRILIFCQLKSMLDIVEHDLLKPHLPSVTYLRLDGSIPPGQRHSIVSRFNNDPSIDVLLLTTHVGGLGLNLTGADTVVFVEHDWNPMRDLQAMDRAHRIGQKRVVNVYRLITRGTLEEKIMGLQKFKMNIANTVISQENSSLQSMGTDQLLDLFTLDKDGKAEKADTSTSGKASMKSILENLSDLWDQEQYDSEYSLENFMHSLK

SEQ ID NO: 25258 - protein, 1849 aa, Homo sapiens [sequence omitted]

SEQ ID NO: 25259 - protein, 482 aa, Homo sapiens
  ENSP00000261721
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRFTVNRRISIVGFGLYGSIHGPTDYQVNIQIIEYEKKQTLGQNDTGFSCDGTANTFRVMFKEPIEILPNVCYTACATLKGPDSHYGTKGLKKVVHETPAASKTVFFFFSSPGNNNGTSIEDGQIPEIIFYT

SEQ ID NO: 25260 - protein, 385 aa, Homo sapiens
  ENSP00000368713
MASLGPAAAGEQASGAEAEPGPAGPPPPPSPSSLGPLLPLQREPLYNWQATKASLKERFAFLFNSELLSDVRFVLGKGRGAAAAGGPQRIPAHRFVLAAGSAVFDAMFNGGMATTSAEIELPDVEPAAFLALLRFLYSDEVQIGPETVMTTLYTAKKYAVPALEAHCVEFLTKHLRADNAFMLLTQARLFDEPQLASLCLDTIDKSTMDAISAEGFTDIDIDTLCAVLERDTLSIRESRLFGAVVRWAEAECQRQQLPVTFGNKQKVLGKALSLIRFPLMTIEEFAAGPAQSGILSDREVVNLFLHFTVNPKPRVEYIDRPRCCLRGKECCINRFQQVESRWGYSGTSDRIRSLNMRKSKPWDRMIPALVVMGQLTHSGSCSRNP

SEQ ID NO: 25261 - protein, 37 aa, Homo sapiens
  ENSP00000453104
  MOD_RES (1)..(1): Any amino acid
XKYAVPALEAHCVEFLTKHLRADNAFMLLTQIHSVQF

SEQ ID NO: 25262 - protein, 1104 aa, Homo sapiens
  ENSP00000280758
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 25263 - protein, 985 aa, Homo sapiens
  ENSP00000413889
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 25264 - protein, 1007 aa, Homo sapiens
  ENSP00000447319
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMEVRDPLWCWLS

SEQ ID NO: 25265 - protein, 222 aa, Homo sapiens
  ENSP00000447606
AAAAVPPAAAANHHHHHHHALHEAPKFTVETLEHTVNNDSEIWGLLQPYQHLICGKNASGDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSL

SEQ ID NO: 25266 - protein, 237 aa, Homo sapiens
  ENSP00000407416
MVESLHGLDSRKGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQ

SEQ ID NO: 25267 - protein, 641 aa, Homo sapiens
  ENSP00000349690
MRKLRPKDSREPAPGSPVRSGCLQRLSHYSGIQRPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 25268 - protein, 183 aa, Homo sapiens
  ENSP00000448322
MSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 25269 - protein, 478 aa, Homo sapiens
  ENSP00000364515
MPRRGYSKPGSWGSFWAMLTLVGLVTHAAQRADVGGEAAGTSINHSQAVLQRLQELLRQGNASDVVLRVQAAGTDEVRVFHAHRLLLGLHSELFLELLSNQSEAVLQEPQDCAAVFDKFIRYLYCGELTVLLTQAIPLHRLATKYGVSSLQRGVADYMRAHLAGGAGPAVGWYHYAVGTGDEALRESCLQFLAWNLSAVAASTEWGAVSPELLWQLLQRSDLVLQDELELFHALEAWLGRARPPPAVAERALRAIRYPMIPPAQLFQLQARSAALARHGPAVADLLLQAYQFHAASPLHYAKFFDVNGSAFLPRNYLAPAWGAPWVINNPARDDRSTSFQTQLGPSGHDAGRRVTWNVLFSPRWLPVSLRPVYADAAGTALPAARPEDGRPRLVVTPASSGGDAAGVSFQKTVLVGARQQGRLLVRHAYSFHQSSEEAGDFLAHADLQRRNSEYLVENALHLHLIVKPVYHTLIRTPK

SEQ ID NO: 25270 - protein, 171 aa, Homo sapiens
  ENSP00000256015
MHPFYTRAATMIGEIAAAVSFISKFLRTKGLTSERQLQTFSQSLQELLAEHYKHHWFPEKPCKGSGYRCIRINHKMDPLIGQAAQRIGLSSQELFRLLPSELTLWVDPYEVSYRIGEDGSICVLYEASPAGGSTQNSTNVQMVDSRISCKEELLLGRTSPSKNYNMMTVSG

SEQ ID NO: 25271 - protein, 84 aa, Homo sapiens
  ENSP00000447551
MDPLIGQAAQRIGLSSQELFRLLPSELTLWVDPYEVSYRIGEDGSICVLYEASPAGGSTQNSTNVQMVDSRISCKEELLLGRTS

SEQ ID NO: 25272 - protein, 158 aa, Homo sapiens
  ENSP00000433553
MSHGKGTDMLPEIAAAVGFLSSLLRTRGCVSEQRLKVFSGALQEALTEHYKHHWFPEKPSKGSGYRCIRINHKMDPIISRVASQIGLSQPQLHQLLPSELTLWVDPYEVSYRIGEDGSICVLYEEAPLAASCGLLTCKNQVLLGRSSPSKNYVMAVSS

SEQ ID NO: 25273 - protein, 158 aa, Homo sapiens; identical to SEQ ID NO: 25272
  ENSP00000290551

SEQ ID NO: 25274 - protein, 158 aa, Homo sapiens; identical to SEQ ID NO: 25272
  ENSP00000433553

SEQ ID NO: 25275 - protein, 158 aa, Homo sapiens; identical to SEQ ID NO: 25272
  ENSP00000290551

SEQ ID NO: 25276 - protein, 526 aa, Homo sapiens
  ENSP00000244513
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEDSAPRDADTLHSKLIPTQPSQGAP

SEQ ID NO: 25277 - protein, 494 aa, Homo sapiens
  ENSP00000484707
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTVIANAQDLSKEIPLSPMGEDSAPRDADTLHSKLIPTQPSQGAP

SEQ ID NO: 25278 - protein, 1050 aa, Homo sapiens
  ENSP00000287598
MAAVKKEGGALSEAMSLEGDEWELSKENVQPLRQGRIMSTLQGALAQESACNNTLQQQKRAFEYEIRFYTGNDPLDVWDRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETARQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 25279 - protein, 96 aa, Homo sapiens
  ENSP00000453861
MAAVKKEGGALSEAMSLEGDEWELSKENVQPLRQGRIMSTLQGALAQESACNNTLQQQKRDGVSLFRPGWSAVARSWLTGSSASWVHANLLPQPPE

SEQ ID NO: 25280 - protein, 1064 aa, Homo sapiens
  ENSP00000398470
MAAVKKEGGALSEAMSLEGDEWELSKENVQPLRQGRIMSTLQGALAQESACNNTLQQQKRAFEYEIRFYTGNDPLDVWDRWVFLFHKDNRNINRYISWTEQNYPQGGKESNMSTLLERAVEALQGEKRYYSDPRFLNLWLKLGRLCNEPLDMYSYLHNQGIGVSLAQFYISWAEEYEARENFRKADAIFQEGIQQKAEPLERLQSQHRQFQARVSRQTLLALEKEEEEEVFESSVPQRSTLAELKSKGKKTARAPIIRVGGALKAPSQNRGLQNPFPQQMQNNSRITVFDENADEASTAELSKPTVQPWIAPPMPRAKENELQAGPWNTGRSLEHRPRGNTASLIAVPAVLPSFTPYVEETARQPVMTPCKIEPSINHILSTRKPGKEEGDPLQRVQSHQQASEEKKEKMMYCKEKIYAGVGEFSFEEIRAEVFRKKLKEQREAELLTSAEKRAEMQKQIEEMEKKLKEIQTTQQERTGDQQEETMPTKETTKLQIASESQKIPGMTLSSSVCQVNCCARETSLAENIWQEQPHSKGPSVPFSIFDEFLLSEKKNKSPPADPPRVLAQRRPLAVLKTSESITSNEDVSPDVCDEFTGIEPLSEDAIITGFRNVTICPNPEDTCDFARAARFVSTPFHEIMSLKDLPSDPERLLPEEDLDVKTSEDQQTACGTIYSQTLSIKKLSPIIEDSREATHSSGFSGSSASVASTSSIKCLQIPEKLELTNETSENPTQSPWCSQYRRQLLKSLPELSASAELCIEDRPMPKLEIEKEIELGNEDYCIKREYLICEDYKLFWVAPRNSAELTVIKVSSQPVPWDFYINLKLKERLNEDFDHFCSCYQYQDGCIVWHQYINCFTLQDLLQHSEYITHEITVLIIYNLLTIVEMLHKAEIVHGDLSPRCLILRNRIHDPYDCNKNNQALKIVDFSYSVDLRVQLDVFTLSGFRTVQILEGQKILANCSSPYQVDLFGIADLAHLLLFKEHLQVFWDGSFWKLSQNISELKDGELWNKFFVRILNANDEATVSVLGELAAEMNGVFDTTFQSHLNKALWKVGKLTSPGALLFQ

SEQ ID NO: 25281 - protein, 66 aa, Homo sapiens
  ENSP00000453643
  MOD_RES (1)..(1): Any amino acid
XQFQARVSRQTLLALEKEEEEEVFESSVPQRSTLAELKSKGKKTARAPIIRVGGALKGHHVKLNLV

SEQ ID NO: 25282 - protein, 154 aa, Homo sapiens
  ENSP00000412072
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLT

SEQ ID NO: 25283 - protein, 216 aa, Homo sapiens
  ENSP00000390766
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLM

SEQ ID NO: 25284 - protein, 294 aa, Homo sapiens
  ENSP00000387086
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIG

SEQ ID NO: 25285 - protein, 419 aa, Homo sapiens
  ENSP00000386474
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 25286 - protein, 423 aa, Homo sapiens
  ENSP00000386837
MVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 25287 - protein, 451 aa, Homo sapiens
  ENSP00000394316
MYGAPGAPAQSASVTVVRSLRRPPPQATGVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 25288 - protein, 116 aa, Homo sapiens
  ENSP00000393587
MVSFMNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQ

SEQ ID NO: 25289 - protein, 161 aa, Homo sapiens
  ENSP00000407268
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANG

SEQ ID NO: 25290 - protein, 135 aa, Homo sapiens
  ENSP00000395673
  MOD_RES (1)..(1): Any amino acid
XGARKELQKELQEQMSRGDPFKDIILYVKEEMKKNNIPEPVVIGIVWSSVMSTVEWNKKEELVAEQAIKHLKQYSPLLAAFTTQAEVLSEEPILKWYKDAHVAKGKSVFLEQMKKFVEWLKNAEEESESEAEEGD

SEQ ID NO: 25291 - protein, 380 aa, Homo sapiens
  ENSP00000306245
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 25292 - protein, 170 aa, Homo sapiens
  ENSP00000450519
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQVRNSSVLFLGMWGLGGKQPRRCRSPVQRMKPLMGLAAHP

SEQ ID NO: 25293 - protein, 137 aa, Homo sapiens
  ENSP00000452443
MMFSGFNADYEASSSRCSSASPAGDSLSYYHSPADSFSSMGSPVNAQCQLHSHGHCHLDQSGPAVAGAARPRLLRGPIADQSPSPFRSPRPLRWGLLQGWRCEDHDRRPSAEHWQEGQGGTVISRRRREKENPKGKE

SEQ ID NO: 25294 - protein, 344 aa, Homo sapiens
  ENSP00000442268
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 25295 - protein, 176 aa, Homo sapiens
  ENSP00000452386
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAVGTLWVAPF

SEQ ID NO: 25296 - protein, 266 aa, Homo sapiens
  ENSP00000452590
MTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 25297 - protein, 142 aa, Homo sapiens
  ENSP00000452440
MTGGRAQSIGRRGKVEQETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDM

SEQ ID NO: 25298 - protein, 83 aa, Homo sapiens
  ENSP00000451786
RLLRGPIADQSPSPFRSPRPLRWGLLQGWRCEDHDRRPSAEHWQEGQGGTEEEEKRRIRRERNKMAAAKCRNRRRELTDTLQA

SEQ ID NO: 25299 - protein, 232 aa, Homo sapiens
  ENSP00000450886
MAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 25300 - protein, 380 aa, Homo sapiens; identical to SEQ ID NO: 25291
  ENSP00000306245

SEQ ID NO: 25301 - protein, 170 aa, Homo sapiens; identical to SEQ ID NO: 25292
  ENSP00000450519

SEQ ID NO: 25302 - protein, 137 aa, Homo sapiens; identical to SEQ ID NO: 25293
  ENSP00000452443

SEQ ID NO: 25303 - protein, 344 aa, Homo sapiens; identical to SEQ ID NO: 25294
  ENSP00000442268

SEQ ID NO: 25304 - protein, 176 aa, Homo sapiens; identical to SEQ ID NO: 25295
  ENSP00000452386

SEQ ID NO: 25305 - protein, 266 aa, Homo sapiens; identical to SEQ ID NO: 25296
  ENSP00000452590

SEQ ID NO: 25306 - protein, 142 aa, Homo sapiens; identical to SEQ ID NO: 25297
  ENSP00000452440

SEQ ID NO: 25307 - protein, 83 aa, Homo sapiens; identical to SEQ ID NO: 25298
  ENSP00000451786

SEQ ID NO: 25308 - protein, 232 aa, Homo sapiens; identical to SEQ ID NO: 25299
  ENSP00000450886

SEQ ID NO: 25309 - protein, 197 aa, Homo sapiens
  ENSP00000331581
MSARAPKELRLALPPCLLNRTFASPNASGSGNTGARGPGAVGSGTCITQVGQQLFQSFSSTLVLIVLVTLIFCLIVLSLSTFHIHKRRMKKRKMQRAQEEYERDHCSGSRGGGGLPRPGRQAPTHAKETRLERQPRDSPFCAPSNASSLSSSSPGLPCQGPCAPPPPPPASSPQGAHAASSCLDTAGEGLLQTVVLS

SEQ ID NO: 25310 - protein, 197 aa, Homo sapiens; identical to SEQ ID NO: 25309
  ENSP00000331581

SEQ ID NO: 25311 - protein, 205 aa, Homo sapiens
  ENSP00000261318
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 25312 - protein, 47 aa, Homo sapiens
  ENSP00000446478
MVNLAAMVWRRLLRKRWVLALVFGLSLVYFLSSTFKQATFARGRICW

SEQ ID NO: 25313 - protein, 46 aa, Homo sapiens
  ENSP00000449151
MAVEDHFELCLAKCRTSSQSVQHENTYRDPIAKYCYGESPPELFPA

SEQ ID NO: 25314 - protein, 43 aa, Homo sapiens
  ENSP00000447722
  MOD_RES (1)..(1): Any amino acid
XFGLSLVYFLSSTFKQSVQHENTYRDPIAKYCYGESPPELFPA

SEQ ID NO: 25315 - protein, 140 aa, Homo sapiens
  ENSP00000256319
MSRFLNVLRSWLVMVSIIAMGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 25316 - protein, 83 aa, Homo sapiens
  ENSP00000490729
MDLSFMAAQLPMMGGAFMDSPNEDFSTEYSLFNSSANVHAAANGQGQPEDPPRSSNDAVLLWIAIIATLGNIVVVGVVYAFTF

SEQ ID NO: 25317 - protein, 92 aa, Homo sapiens
  ENSP00000489964
MDQPNSFPVCRCHLEFFQLPMMGGAFMDSPNEDFSTEYSLFNSSANVHAAANGQGQPEDPPRSSNDAVLLWIAIIATLGNIVVVGVVYAFTF

SEQ ID NO: 25318 - protein, 83 aa, Homo sapiens; identical to SEQ ID NO: 25316
  ENSP00000490894

SEQ ID NO: 25319 - protein, 114 aa, Homo sapiens
  ENSP00000490925
MDLSFMAAQNKDKSRISPSVCDPREDPELAPGKGCVWPGRLPMMGGAFMDSPNEDFSTEYSLFNSSANVHAAANGQGQPEDPPRSSNDAVLLWIAIIATLGNIVVVGVVYAFTF

SEQ ID NO: 25320 - protein, 83 aa, Homo sapiens; identical to SEQ ID NO: 25316
  ENSP00000490729

SEQ ID NO: 25321 - protein, 92 aa, Homo sapiens; identical to SEQ ID NO: 25317
  ENSP00000489964

SEQ ID NO: 25322 - protein, 83 aa, Homo sapiens; identical to SEQ ID NO: 25316
  ENSP00000490894

SEQ ID NO: 25323 - protein, 114 aa, Homo sapiens; identical to SEQ ID NO: 25319
  ENSP00000490925

SEQ ID NO: 25324 - protein, 774 aa, Homo sapiens
  ENSP00000267485
MRGPIVLHICLAFCSLLLFSVATQCLAFPKIERRREIAHVHAEKGQSDKMNTDDLENSSVTSKQTPQLVVSEDPMMMSAVPSATSLNKAFSINKETQPGQAGLMQTERPGVSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLVRSWMEKLKDKAGYMSGMLVPVGVGIAGALFILGALYSIKVMNRRRRNGFKRHKRKQREFNSMQDRVMLLADSSEDEF

SEQ ID NO: 25325 - protein, 97 aa, Homo sapiens
  ENSP00000477692
  MOD_RES (1)..(1): Any amino acid
XVVPLSFEVTPTVEEQMDTVTGPNEEFTPVLGSPVTPPGIMVGEPSISPALPALEASSERRTVVPSITRVNTAASYGLDQLESEGIHALKGIFSRTG

SEQ ID NO: 25326 - protein, 180 aa, Homo sapiens
  ENSP00000359401
MAESGKEKIKWTTTIIISSSLKSYEVATALENRSHKVRYSDSVENGSIIFSLSGVAFLLMDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 25327 - protein, 121 aa, Homo sapiens
  ENSP00000359399
MDTKECLLSTEEIFLAKIEKFINIHQNSFLVLSAALHGPEEWKLMFRIQQRFLGCNLRILPVHNTVNAINLMCTIAKTTSKPYIDSICYRMITAKAYIIEQSPVWKTLQKIKLNSDSVNPN

SEQ ID NO: 25328 - protein, 121 aa, Homo sapiens
  ENSP00000235307
MGCASAKHVATVQNEEEAQKGKNYQNGDVFGDEYRIKPVEEVKYMKNGAEEEQKIAARNQENLEKSASSNVRLKTNKEVPGLVHQPRANMHISESQQEFFRMLDEKIEKGRDYCSEEEDIT

SEQ ID NO: 25329 - protein, 66 aa, Homo sapiens
  ENSP00000383776
  MOD_RES (1)..(1): Any amino acid
XQPQGPPEQSLLLTEAWSWASKKKQPHLFSGVIVGGHLWLLGPKRRMYFIWLGWIPSDKPSQLTER

SEQ ID NO: 25330 - protein, 188 aa, Homo sapiens
  ENSP00000357225
  MOD_RES (1)..(1): Any amino acid
XAQRGPGKAGLTGGRERLERGARAARTDQHQRIQEEERDLTGSGDISPPQHPSRHSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 25331 - protein, 140 aa, Homo sapiens
  ENSP00000310651
GPPEQSLLLTEAWSWASKKKQPHLFSGVIVGGHLWLLGFSPGAGGFCTTLPPSFLRVDDRATSSTTDSSRAPSSPRPPGSTSHCGISTRCTERCLCVLPLRTSQVPDVMAPQHDQEPKRRMYFIWLGWIPSDKPSQLTER

SEQ ID NO: 25332 - protein, 156 aa, Homo sapiens
  ENSP00000357226
MFLTEDLITFNLRNFLLFQLWESSFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 25333 - protein, 169 aa, Homo sapiens
  ENSP00000350661
PPEQSLLLTEAWSWASKKKQPHLFSGVIVGGHLWLLGFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 25334 - protein, 156 aa, Homo sapiens; identical to SEQ ID NO: 25332
  ENSP00000479346

SEQ ID NO: 25335 - protein, 141 aa, Homo sapiens
  ENSP00000355752
MEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAISQGYKEQGIPQQL

SEQ ID NO: 25336 - protein, 141 aa, Homo sapiens [sequence omitted]

SEQ ID NO: 25337 - protein, 245 aa, Homo sapiens
  ENSP00000363773
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 25338 - protein, 220 aa, Homo sapiens
  ENSP00000416841
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKD

SEQ ID NO: 25339 - protein, 245 aa, Homo sapiens; identical to SEQ ID NO: 25337
  ENSP00000385564

SEQ ID NO: 25340 - protein, 153 aa, Homo sapiens
  ENSP00000426317
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEP

SEQ ID NO: 25341 - protein, 251 aa, Homo sapiens
  ENSP00000423689
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 25342 - protein, 228 aa, Homo sapiens
  ENSP00000404606
MKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKN

SEQ ID NO: 25343 - protein, 253 aa, Homo sapiens
  ENSP00000313967
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 25344 - protein, 258 aa, Homo sapiens
  ENSP00000253407
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 25345 - protein, 287 aa, Homo sapiens
  ENSP00000272520
MALGLLIAVPLLLQAAPRGAAHYEMMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 25346 - protein, 329 aa, Homo sapiens
  ENSP00000302274
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRPGARRAASQSAMLQLDYGDTVWLRLHGAPQYALGAPGATFSGYLVYADADADAPARGPPAPPEPRSAFSAARTRSLVGSDAGPGPRHQPLAFDTEFVNIGGDFDAAAGVFRCRLPGAYFFSFTLGKLPRKTLSVKLMKNRDEVQAMIYDDGASRRREMQSQSVMLALRRGDAVWLLSHDHDGYGAYSNHGKYITFSGFLVYPDLAPAAPPGLGASELL

SEQ ID NO: 25347 - protein, 100 aa, Homo sapiens
  ENSP00000434548
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDE

SEQ ID NO: 25348 - protein, 66 aa, Homo sapiens
  ENSP00000444157
  MOD_RES (1)..(1): Any amino acid
XNPAKVQNHCQEPYYQAAAAGALTCATPGTWKDRQDGEEVLQCMPGCGSYADPITDQPSVRFSPQL

SEQ ID NO: 25349 - protein, 110 aa, Homo sapiens
  ENSP00000438286
MPGPRVWGKYLWRSPHSKGCPGAISHSSVRIQASSVVSKAPLWAGPLVRGSFQPISEASRGSEAINAPGDNPAKVQNHCQEPYYQAAAAGCGSYADPITDQPSVRFSPQL

SEQ ID NO: 25350 - protein, 487 aa, Homo sapiens
  ENSP00000266542
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDETQRHSVCQGDSGSVYVVWDNHAHHWVATGIVSWGIGCGEGYDFYTKVLSYVDWIKGVMNGKN

SEQ ID NO: 25351 - protein, 314 aa, Homo sapiens
  ENSP00000441885
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAASTPSLFLCLSSFTPQGHSPVQPQGPGKTDRMGRRFFSVCLSADGQSPPLPRIRRPSVLPEPSWATSPGKPSPVSTAVGAGPCWGTDGSSLLPTPSTPRTVFLSGRTRV

SEQ ID NO: 25352 - protein, 194 aa, Homo sapiens
  ENSP00000439180
  MOD_RES (1)..(1): Any amino acid
XSFVGSDPSQFCGQQGSPLGRPPGQREFVSSGRSLRLTFRTQPSSENKTAHLHKGFLALYQTVVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLP

SEQ ID NO: 25353 - protein, 191 aa, Homo sapiens
  ENSP00000437398
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVGALTCATPGTWKDRQDGEEVLQCMPVCG

SEQ ID NO: 25354 - protein, 85 aa, Homo sapiens
  ENSP00000438951
  MOD_RES (1)..(1): Any amino acid
XPGLRPGAVPGLCRGLCHNLIRRFGSKPVLWSARLPSGQAPWSEGVCILREEFAADLPHTAFLGEQDCPPPQGLPGPLPNRGCEL

SEQ ID NO: 25355 - protein, 83 aa, Homo sapiens
  ENSP00000437569
GLRPGAVPGLCRGLCHNLIRRFGSKPVLWSARLPSGQAPWSEGVCILREEFAADLPHTAFLGEQDCPPPQGLPGPLPNRGCEL

SEQ ID NO: 25356 - protein, 187 aa, Homo sapiens
  ENSP00000442611
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVGECPSWGCREGASVPSHDPGIFKP

SEQ ID NO: 25357 - protein, 385 aa, Homo sapiens
  ENSP00000312770
MWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 25358 - protein, 295 aa, Homo sapiens
  ENSP00000362743
MERELEALAARLARPAEPPFQALVEAAGGRGQVLLVGELWEREQSRALLRDFARAVFPPEPGAAKPGGAAAEGAGPGAARGAQRAARAAGAAGAAAAAARAIRSPLVFVLCRASSLAAREPRRRLREMLRDVRGRRRAGAALVGVLVAEAGPEDAVAPGLRLLEALLRAVFGRQAGGPVQAAAYCPGLPASCLAVQAAACRALQAAGAGQPVEGAWERPGLPGLLACFSWGPWSRRKNQDVAACRSSAQEDFQEPEEELPLTAIFPNGDCDDLGRGSKACDGVVHTPAEPTGDSR

SEQ ID NO: 25359 - protein, 295 aa, Homo sapiens; identical to SEQ ID NO: 25358
  ENSP00000362743

SEQ ID NO: 25360 - protein, 223 aa, Homo sapiens
  ENSP00000417971
MQVSNGFSQELALFGQHKIEDAAITYVSENEEIKHEEKPGKSIHHSKSHVGRGRIYYAKFINTNARTYNEPFPYIDPKKGPEIQGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESR

SEQ ID NO: 25361 - protein, 113 aa, Homo sapiens
  ENSP00000385348
MEEKEDKHQQHKIEDAAITYGDWWSHGKALEPVFLPPYDSKSTQRSDFQKPSCPLVLPVKHSKMQKPSCGIDETLRKGAKTVTVVLCHSAGRKGTERSRACFFRWFHAILFSP

SEQ ID NO: 25362 - protein, 287 aa, Homo sapiens
  ENSP00000381631
MEEKEDKHQQHKIEDAAITYVSENEEIKHEEKPGKSIHHSKSHVGRGRIYYAKFINTNARTYNEPFPYIDPKKGPEIQGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTPESREKTSGATQTTVGDALFTRHKPLNPPIKKSE

SEQ ID NO: 25363 - protein, 59 aa, Homo sapiens
  ENSP00000325555
MEEKEDKHQVTGGHMVKHWNLSSYHLTTLRAPRGVTSKNHRVHWFCQSNTARCKSLLVE

SEQ ID NO: 25364 - protein, 211 aa, Homo sapiens
  ENSP00000389570
MEEKEDKHQQHKIEDAAITYGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTPESREKTSGATQTTVG

SEQ ID NO: 25365 - protein, 82 aa, Homo sapiens
  ENSP00000403195
  MOD_RES (1)..(1): Any amino acid
XEDKHQQHKIEDAAITYGDWWSHGKALEPVFLPPYDSKSTQRSDFQKPSCPLVLPVKHSKMQKPSCGIETRSFCTERDKTRQ

SEQ ID NO: 25366 - protein, 70 aa, Homo sapiens
  ENSP00000481108
MISPGLCQQNSQELLEPKTHLSETDVRQAAKACPSTPESREKTSGATQTTVGDALFTRHKPLNPPIKKSE

SEQ ID NO: 25367 - protein, 1663 aa, Homo sapiens
  ENSP00000245907
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 25368 - protein, 100 aa, Homo sapiens
  ENSP00000469482
  MOD_RES (1)..(1): Any amino acid
XFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPK

SEQ ID NO: 25369 - protein, 101 aa, Homo sapiens
  ENSP00000471384
NNEKDMALTAFVLISLQEAKDICEEQVNSLPGSITKAGDFLEANYMNLQRSYTVAIAGYALAQMGRLKGPLLNKFLTTAKDEENQKQCQDLGAFTESMVVF

SEQ ID NO: 25370 - protein, 192 aa, Homo sapiens
  ENSP00000469744
ITHRIHWESASLLRSEETKENEGFTVTAEGKGQGTLSVVTMYHAKAKDQLTCNKFDLKVTIKPAPETGIPSPIFLSSVFLEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNL

SEQ ID NO: 25371 - protein, 103 aa, Homo sapiens
  ENSP00000472044
MVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGST

SEQ ID NO: 25372 - protein, 233 aa, Homo sapiens
  ENSP00000350818
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSSVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYVQAVIFDHISRRKT

SEQ ID NO: 25373 - protein, 86 aa, Homo sapiens
  ENSP00000426308
MDQEEGLKALDNIVTQFNAYEDFLDSQITTVDLYYLEDETLARQLVELGYRGTGERVKREDFEARKAAIEIARLAERAQQKCQTLS

SEQ ID NO: 25374 - protein, 156 aa, Homo sapiens
  ENSP00000422569
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSAGVQWHHLGSLQPLPPGFKEFSCFSLPSSWDYRHAPPHPVRDLYS

SEQ ID NO: 25375 - protein, 250 aa, Homo sapiens
  ENSP00000425786
MDQEEGLKALDNIVTQFNAYEDFLDSQITTVDLYYLEDETLARQLVELGYRGTGERVKREDFEARKAAIEIARLAERAQQKTLTSAGKDLQDNFLTALAMREEDNRSGKLSLNQQETDAAHILKKQLASVIFIRDRNSHGQEISGYIDYAHRLKTEDFEVYFTGKKRLLPRPTDISFYNWDADIAVSNSSPNYQVIADNPEGLLFRYKRDRKILNVDPKAQPGDNSTRITILTELYVQAVIFDHISRRKT

SEQ ID NO: 25376 - protein, 75 aa, Homo sapiens
  ENSP00000480723
SFYNWDADIAVSNSSPNYQVIADNPEGLLFRYKRDRKILNVDPKAQPGDNSTRITILTELYVQAVIFDHISRRKT

SEQ ID NO: 25377 - protein, 199 aa, Homo sapiens
  ENSP00000281146
MDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRMSRGETKWEGKAYLPWSYFPPNVTKFNSFAIHGSKDKRSYEALYPVPQHELQQGQKPDFHCLEYFKSFNFNTLLGEEWKQPESDLWLIEKCDI

SEQ ID NO: 25378 - protein, 165 aa, Homo sapiens
  ENSP00000427406
MDFKIEHTWDGFPVKHEPVFIRLNPGDRGVMMDISAPFFRDPPAPLGEPGKPFNELWDYEVVEAFFLNDITEQYLEVELCPHGQHLVLLLSGRRNVWKQELPLSFRMSRGETKWEGKAYLPWSYFPPNVTKFNSFAIHGSKDKRSYEALYPVPQHELQQGQKPDL

SEQ ID NO: 25379 - protein, 102 aa, Homo sapiens
  ENSP00000427096
MDFKIEHTWDGFPVKHEPVFIRLNPGDRGVMMDISAPFFRDPPAPLGEPGKPFNELWDYEVVEAFFLNDITEQYLEVELCPKNFLYRSECPEERQNGKAKLI

SEQ ID NO: 25380 - protein, 64 aa, Homo sapiens
  ENSP00000427431
MDFKIEHTWDGFPVKHEPVFIRLNPGDRGVMMDISAPFFRDPPAPLGEPGKPFNELWDYEVVEA

SEQ ID NO: 25381 - protein, 199 aa, Homo sapiens; identical to SEQ ID NO: 25377
  ENSP00000401090

SEQ ID NO: 25382 - protein, 298 aa, Homo sapiens
  ENSP00000363135
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 25383 - protein, 232 aa, Homo sapiens
  ENSP00000363138
MEGMDVDLDPELMQKFSCLGTTDKDVLISEFQRLLGFQLNPAGCAFFLDMTNWNLQAAIGAYYDFESPNISVPSMSFVEDVTIGEGESIPPDTQFVKTWRIQNSDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 25384 - protein, 224 aa, Homo sapiens
  ENSP00000363133
MSFVEDVTIGEGESIPPDTQFVKTWRIQNSGAEAWPPGVCLKYVGGDQFGHVNMVMVRSLEPQEIADVSVQMCSPSRAGMYQGQWRMCTATGLYYGDVIWVILSVEVGGLLGVTQQLSSFETEFNTQPHRKVEGNFNPFASPQKNRQSDENNLKDPGGSEFDSISKNTWAPAPDTWAPAPDQTEQDQNRLSQNSVNLSPSSHANNLSVVTYSKGLHGPYPFGQS

SEQ ID NO: 25385 - protein, 538 aa, Homo sapiens
  ENSP00000427820
MSSPLASELSELAALRPGFRLSAPHARVAPRAATHARGRGRASHAGQPRLRSSCPGPSPGKRRVVPSGGAQPRVLPALSSRSHLFPMASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 25386 - protein, 129 aa, Homo sapiens
  ENSP00000429102
MASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSCKEVSYSNAIQSM

SEQ ID NO: 25387 - protein, 287 aa, Homo sapiens
  ENSP00000345255
MASHPQTRIQAYLEKNKIGPLFEELMTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLGNFKN

SEQ ID NO: 25388 - protein, 427 aa, Homo sapiens
  ENSP00000337174
MTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLKMEPKNKGLKQQQQQHKKLLAAMLSQDSFESIHSPTPSVTEEDIDNEDDAMELLEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKRSADLLLCVPCSSCPTLVYSGL

SEQ ID NO: 25389 - protein, 206 aa, Homo sapiens
  ENSP00000429081
MTKLITETPDQPIPFLIDHLQSKQGNRGQLQRTLSGSAALWAESEKSESKGTRRDFRSYDKPWQLNAKKPKKSKSDLAVSNISPPSPDSKSLPRSVEHPKWNWRTKPQSRDFDELNHILQESKKLGKALENLSRSIAISDELDKETVTFNSSLLRPRVIGEWIGREENDADPLAAEMLQPPIPRSKNDQWESEDSGSSPAGSLEDT

SEQ ID NO: 25390 - protein, 201 aa, Homo sapiens
  ENSP00000319532
MENGFTMCQTGRQHPVACGLHLSGGKEDLNDLRMEGVTTLVPSGSKFNQGRPTYPAEPQAKVTLNICSRCARLQGDNLEERTEESLPILHSPDEKIPDSFDSLPGTEEALMEEGDEFEKASKLTGPGEASSGVGHSLKNYMEEDESLKQLQVVHQPWILPSDTESEGVEAEQEKHLLNQNLCGWDSEFCIFHTLASFLIYK

SEQ ID NO: 25391 - protein, 207 aa, Homo sapiens
  ENSP00000302260
MMHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIPPVPRISVKTSASASLEATAMGTEKGAVLMRGSRHLKKMTEEYPALPQGAEASLPLTGSASCGVPGILRKMWTRHKKKSEYVGATNSAFEAD

SEQ ID NO: 25392 - protein, 122 aa, Homo sapiens
  ENSP00000430501
MMHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIQTSQEDD

SEQ ID NO: 25393 - protein, 77 aa, Homo sapiens
  ENSP00000430388
MMHQIYSCSDENIEVFTTVIPSKVSSPARRRAKSSQHLLTKNILSLFLEFTGITKDPETPSMRAPSAKLLPWGSMGP

SEQ ID NO: 25394 - protein, 48 aa, Homo sapiens
  ENSP00000473681
MMHQIYSCSDENIEVFTTVIPSKVSSPARRRAKSSQHLLTKNTLLDQG

SEQ ID NO: 25395 - protein, 134 aa, Homo sapiens
  ENSP00000430141
MMHQIYSCSDENIEVFTTVIPSKVSSPARRRAKSSQHLLTKNVVIESDLYTHQPLELLPHRGDRRDPGDRRRFGRLQTARPPTAHPAKASARPDTASAPDLSENFSLCLIGGDSHGHREGSCSDERIQTSQEDD

SEQ ID NO: 25396 - protein, 147 aa, Homo sapiens
  ENSP00000429883
MMHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIPPVPRISVKTSASASLEATAMGTEKGAVLMRG

SEQ ID NO: 25397 - protein, 207 aa, Homo sapiens; identical to SEQ ID NO: 25391
  ENSP00000302260

SEQ ID NO: 25398 - protein, 122 aa, Homo sapiens; identical to SEQ ID NO: 25392
  ENSP00000430501

SEQ ID NO: 25399 - protein, 77 aa, Homo sapiens; identical to SEQ ID NO: 25393
  ENSP00000430388

SEQ ID NO: 25400 - protein, 48 aa, Homo sapiens; identical to SEQ ID NO: 25394
  ENSP00000473681

SEQ ID NO: 25401 - protein, 134 aa, Homo sapiens; identical to SEQ ID NO: 25395
  ENSP00000430141

SEQ ID NO: 25402 - protein, 147 aa, Homo sapiens; identical to SEQ ID NO: 25396
  ENSP00000429883

SEQ ID NO: 25403 - protein, 229 aa, Homo sapiens
  ENSP00000366402
MDSLDRSCQDWCDRKQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMCALTTYSEDYVPPYDYQPHAYPCQDDYSIVHRKCRSQFTDLNGSKRFGINTWHDESGIYANSDVKQKLYPLTSGPIVPI

SEQ ID NO: 25404 - protein, 159 aa, Homo sapiens
  ENSP00000431855
MDSLDRSCQDWCDRKQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMLIPVKMIIP

SEQ ID NO: 25405 - protein, 50 aa, Homo sapiens
  ENSP00000434032
MDSLDRSCQDWCDRKQHWLEIGPPDLVERKGSLTLRSHHKKYSKPVLVYS

SEQ ID NO: 25406 - protein, 50 aa, Homo sapiens; identical to SEQ ID NO: 25405
  ENSP00000436701

SEQ ID NO: 25407 - protein, 37 aa, Homo sapiens
  ENSP00000433973
  MOD_RES (1)..(1): Any amino acid
XKQHWLEIGPPDLVERKGSLTLRSHHKKYSKPVLVYS

SEQ ID NO: 25408 - protein, 149 aa, Homo sapiens
  ENSP00000433123
  MOD_RES (1)..(1): Any amino acid
XERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMLVVPKLLQLYKMFLDSEGLFAGAKV

SEQ ID NO: 25409 - protein, 481 aa, Homo sapiens
  ENSP00000369339
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLNAISSHLQTCGCSVVVGSSAEKVNKIVRTLCLFLTPAERKCSRLCEAESSFKYESGLFVQGLLKDSTGSFVLPFRQVMYAPYPTTHIDVDVNTVKQMPPCHEHIYNQRRYMRSELTAFWRATSEEDMAQDTIIYTDESFTPDLNIFQDVLHRDTLVKAFLDQVFQLKPGLSLRSTFLAQFLLVLHRKALTLIKYIEDDTQKGKKPFKSLRNLKIDLDLTAEGDLNIIMALAEKIKPGLHSFIFGRPFYTSVQERDVLMTF

SEQ ID NO: 25410 - protein, 222 aa, Homo sapiens
  ENSP00000369333
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDRSTYGLSIILPQTELSFYLPLHRVCVDRLTHIIRKGRIWMHKERQENVQKIILEGTERMEDQGQSIIPMLTGEVIPVMELLSSMKSHSVPEEIDIADTVLNDDDIGDSCHEGFLLK

SEQ ID NO: 25411 - protein, 222 aa, Homo sapiens; identical to SEQ ID NO: 25410
  ENSP00000369331

SEQ ID NO: 25412 - protein, 481 aa, Homo sapiens; identical to SEQ ID NO: 25409
  ENSP00000482753

SEQ ID NO: 25413 - protein, 264 aa, Homo sapiens [sequence omitted]

SEQ ID NO: 25414 - protein, 44 aa, Homo sapiens
  ENSP00000447178
MSLSITNNGHSVQVDFNDSDDRTAASGSLECQEVQHFWGGGLST

SEQ ID NO: 25415 - protein, 208 aa, Homo sapiens
  ENSP00000377632
MSLSITNNGHSVQVDFNDSDDRTVVTGGPLEGPYRLKQFHFHWGKKHDVGSEHTVDGKSFPSELHLVHWNAKKYSTFGEAASAPDGLAVVGVFLETGDEHPSMNRLTDALYMVRFKGTKAQFSCFNPKCLLPASRHYWTYPGSLTTPPLSESVTWIVLREPICISERQMGKFRSLLFTSEDDERIHMVNNFRPPQPLKGRVVKASFRA

SEQ ID NO: 25416 - protein, 264 aa, Homo sapiens [sequence omitted]

SEQ ID NO: 25417 - protein, 44 aa, Homo sapiens; identical to SEQ ID NO: 25414
  ENSP00000447178

SEQ ID NO: 25418 - protein, 208 aa, Homo sapiens; identical to SEQ ID NO: 25415
  ENSP00000377632

SEQ ID NO: 25419 - protein, 337 aa, Homo sapiens
  ENSP00000348113
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFKDLLTRHKVLVADFLEQNYDTIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 25420 - protein, 337 aa, Homo sapiens; identical to SEQ ID NO: 25419
  ENSP00000386375

SEQ ID NO: 25421 - protein, 193 aa, Homo sapiens
  ENSP00000387245
MLRECIRHEPLAKIILFSNQFRDFFKYVELSTFDIASDAFATFKDLLTRHKVLVADFLEQNYDTIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 25422 - protein, 280 aa, Homo sapiens
  ENSP00000416719
ASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFKIFEDYEKLLQSENYVTKRQSLKLLGELILDRHNFAIMTKYISKPENLKLMMNLLRDKSPNIQFEAFHVFKVFVASPHKTQPIVEILLKNQPKLIEFLSSFQKERTDDEQFADEKNYLIKQIRDLKKTAP

SEQ ID NO: 25423 - protein, 337 aa, Homo sapiens; identical to SEQ ID NO: 25419
  ENSP00000386328

SEQ ID NO: 25424 - protein, 188 aa, Homo sapiens
  ENSP00000409253
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFMLLKGYEAPQIALRCGIMLRECIRHEPLAKIILFSNQFRDFFKYVELSTFDIASDAFATFK

SEQ ID NO: 25425 - protein, 128 aa, Homo sapiens
  ENSP00000404028
MKKMPLFSKSHKNPAEIVKILKDNLAILEKQDKKTDKASEEVSKSLQAMKEILCGTNEKEPPTEAVAQLAQELYSSGLLVTLIADLQLIDFEGKKDVTQIFNNILRRQIGTRSPTVEYISAHPHILFM

SEQ ID NO: 25426 - protein, 93 aa, Homo sapiens
  ENSP00000386979
MKKMPLFSKSHKNPAEIVKILKDNLAILEKQDKKTDKASEEVSKSLQAMKEILCGTNEKEPPTEAVAQLAQELYSSGLLVTLIADLQLIDFEV

SEQ ID NO: 25427 - protein, 337 aa, Homo sapiens; identical to SEQ ID NO: 25419
  ENSP00000479669

SEQ ID NO: 25428 - protein, 337 aa, Homo sapiens; identical to SEQ ID NO: 25419
  ENSP00000261669

SEQ ID NO: 25429 - protein, 357 aa, Homo sapiens
  ENSP00000394209
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKC

SEQ ID NO: 25430 - protein, 2220 aa, Homo sapiens
  ENSP00000263119
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 25431 - protein, 2141 aa, Homo sapiens
  ENSP00000384694
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 25432 - protein, 361 aa, Homo sapiens
  ENSP00000412389
MIRIAALNASSTIEDDHEGSFKSHKTQTKEAQEAEAFALYHKALDLQKHDRFEESAKAYHELLEASLLREAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCDMSIHDVSVSAAETQAIVDEALGLRKKRQALIVREKEPDLKLVQPIPFFTWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEE

SEQ ID NO: 25433 - protein, 2220 aa, Homo sapiens; identical to SEQ ID NO: 25430
  ENSP00000381364

SEQ ID NO: 25434 - protein, 590 aa, Homo sapiens
  ENSP00000336991
MPRRSRRGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 25435 - protein, 2170 aa, Homo sapiens
  ENSP00000480560
MIRIAALNASSTIEDDHEGSFKSHKTQTKEAQEAEAFALYHKALDLQKHDRFEESAKAYHELLEASLLREAVSSGDEKEGLKHPGLILKYSTYKNLAQLAAQREDLETAMEFYLEAVMLDSTDVNLWYKIGHVALRLIRIPLARHAFEEGLRCNPDHWPCLDNLITVLYTLSDYTTCLYFICKALEKDCRYSKGLVLKEKIFEEQPCLRKDSLRMFLKCWKCLGESLLAMYNHLTTCEPPRPSLGKRIDLSDYQDPSQPLESSMVVTPVNVIQPSTVSTNPAVAVAEPVVSYTSVATTSFPLHSPGLLETGAPVGDISGGDKSKKGVKRKKISEESGETAKRRSARVRNTKCKKEEKVDFQELLMKFLPSRLRKLDPEEEDDSFNNYEVQSEAKLESFPSIGPQRLSFDSATFMESEKQDVHEFLLENLTNGGILELMMRYLKAMGHKFLVRWPPGLAEVVLSVYHSWRRHSTSLPNPLLRDCSNKHIKDMMLMSLSCMELQLDQWLLTKGRSSAVSPRNCPAGMVNGRFGPDFPGTHCLGDLLQLSFASSQRDLFEDGWLEFVVRVYWLKARFLALQGDMEQALENYDICTEMLQSSTAIQVEAGAERRDIVIRLPNLHNDSVVSLEEIDKNLKSLERCQSLEEIQRLYEAGDYKAVVHLLRPTLCTSGFDRAKHLEFMTSIPERPAQLLLLQDSLLRLKDYRQCFECSDVALNEAVQQMVNSGEAAAKEEWVATVTQLLMGIEQALSADSSGSILKVSSSTTGLVRLTNNLIQVIDCSMAVQEEAKEPHVSSVLPWIILHRIIWQEEDTFHSLCHQQQLQNPAEEGMSETPMLPSSLMLLNTAHEYLGRRSWCCNSDGALLRFYVRVLQKELAASTSEDTHPYKEELETALEQCFYCLYSFPSKKSKARYLEEHSAQQVDLIWEDALFMFEYFKPKTLPEFDSYKTSTVSADLANLLKRIATIVPRTERPALSLDKVSAYIEGTSTEVPCLPEGADPSPPVVNELYYLLADYHFKNKEQSKAIKFYMHDICICPNRFDSWAGMALARASRIQDKLNSNELKSDGPIWKHATPVLNCFRRALEIDSSNLSLWIEYGTMSYALHSFASRQLKQWRGELPPELVQQMEGRRDSMLETAKHCFTSAARCEGDGDEEEWLIHYMLGKVAEKQQQPPTVYLLHYRQAGHYLHEEAARYPKKIHYHNPPELAMEALEVYFRLHASILKLLGKPDSGVGAEVLVNFMKEAAEGPFARGEEKNTPKASEKEKACLVDEDSHSSAGTLPGPGASLPSSSGPGLTSPPYTATPIDHDYVKCKKPHQQATPDDRSQDSTAVALSDSSSTQDFFNEPTSLLEGSRKSYTEKRLPILSSQAGATGKDLQGATEERGKNEESLESTEGFRAAEQGVQKPAAETPASACIPGKPSASTPTLWDGKKRGDLPGEPVAFPQGLPAGAEEQRQFLTEQCIASFRLCLSRFPQHYKSLYRLAFLYTYSKTHRNLQWARDVLLGSSIPWQQLQHMPAQGLFCERNKTNFFNGIWRIPVDEIDRPGSFAWHMNRSIVLLLKVLAQLRDHSTLLKVSSMLQRTPDQGKKYLRDADRQVLAQRAFILTVKVLEDTLSELAEGSERPGPKVCGLPGARMTTDVSHKASPEDGQEGLPQPKKPPLADGSGPGPEPGGKVGLLNHRPVAMDAGDSADQSGERKDKESPRAGPTEPMDTSEATVCHSDLERTPPLLPGRPARDRGPESRPTELSLEELSISARQQPTPLTPAQPAPAPAPATTTGTRAGGHPEEPLSRLSRKRKLLEDTESGKTLLLDAYRVWQQGQKGVAYDLGRVERIMSETYMLIKQVDEEAALEQAVKFCQVHLGAAAQRQASGDTPTTPKHPKDSRENFFPVTVVPTAPDPVPADSVQRPSDAHTKPRPALAAATTIITCPPSASASTLDQSKDPGPPRPHRPEATPSMASLGPEGEELARVAEGTSFPPQEPRHSPQVKMAPTSSPAEPHCWPAEAALGTGAEPTCSQEGKLRPEPRRDGEAQEAASETQPLSSPPTAASSKAPSSGSAQPPEGHPGKPEPSRAKSRPLPNMPKLVIPSAATKFPPEITVTPPTPTLLSPKGSISEETKQKLKSAILSAQSAANVRKESLCQPALEVLETSSQESSLESETDEDDDYMDI

SEQ ID NO: 25436 - protein, 1149 aa, Homo sapiens
  ENSP00000361423
MGQQPGKVLGDQRRPSLPALHFIKGAGKKESSRHGGPHCNVFVEHEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 25437 - protein, 64 aa, Homo sapiens
  ENSP00000376971
MGQQPGKVLGDQRRPSLPALHFIKGAGKKESSRHGGPHCNVFVEHALQRPVASDFEPQGLSEAA

SEQ ID NO: 25438 - protein, 1130 aa, Homo sapiens
  ENSP00000323315
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 25439 - protein, 306 aa, Homo sapiens
  ENSP00000383321
MRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 25440 - protein, 38 aa, Homo sapiens
  ENSP00000464435
MRQHDTRNGRIVLISGRRSFCSIFSVLPYRDSTQVGQQ

SEQ ID NO: 25441 - protein, 9 aa, Homo sapiens
  ENSP00000461994
MRQHDTRNG

SEQ ID NO: 25442 - protein, 633 aa, Homo sapiens
  ENSP00000256925
MAAAAAAATTAACSSGSAGTDAAGASGLQQPPPQPQPQPAAAAPAQPPPEPPRKPRMDPRRRQAALSFLTNISLDGRLPPQDAEWGGGEEGGAAKPGAGGACGARTRFSLLAAAERGGCIALAAPGTPAAGLAAGSGPCLPQPSSLPPLIPGGHATVSGPGVARGFASPLGAGRASGEQWQPPRPAPLAACAQLQLLDGSGAAGQEELEEDDAFISVQVPAAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 25443 - protein, 163 aa, Homo sapiens
  ENSP00000476575
  MOD_RES (1)..(1): Any amino acid
XAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGYVYACMLCSSLGEKISHQCT

SEQ ID NO: 25444 - protein, 368 aa, Homo sapiens
  ENSP00000413851
MLSKRGCHARIYADFPIRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 25445 - protein, 370 aa, Homo sapiens
  ENSP00000317310
MGGGDGAAFKRPGDGARLQRVLGLGSRREPRSLPAGGPAPRRTAPPPPGHASAGPAAMSSHIAKSESKTSLLKAAAAAASGGSRAPRHGPARDPGLPSRRLPGSCPATPQSSGDPSSRRPLCRPAPREEGARGSQRVLPQAHCRPREALPAAASRPSPSSPLPPARGRDGEERGLSPALGLRGSLRARGRGDSVPAAASEADPFLHRLRPMLSSAFGQDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 25446 - protein, 227 aa, Homo sapiens
  ENSP00000288616
MGNCVKYPLRNLSRKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 25447 - protein, 167 aa, Homo sapiens
  ENSP00000288615
MGNCVKYPLRNLSRKDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 25448 - protein, 306 aa, Homo sapiens
  ENSP00000398959
MCQCVRACVCVCVCACATQRASHSALPGTTISVKDWRLCLLDQFDACARSGLSEPRSLTLRVPSCGKPLPGPGARLGREVTPCLSFAFAWCWLKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 25449 - protein, 1223 aa, Homo sapiens
  ENSP00000290039
MRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRMALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 25450 - protein, 2506 aa, Homo sapiens
  ENSP00000353362
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25451 - protein, 2507 aa, Homo sapiens
  ENSP00000489778
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25452 - protein, 2261 aa, Homo sapiens
  ENSP00000490323
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 25453 - protein, 2261 aa, Homo sapiens
  ENSP00000489913
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 25454 - protein, 981 aa, Homo sapiens
  ENSP00000467729
QEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25455 - protein, 2460 aa, Homo sapiens
  ENSP00000489861
MARFGDEMPARYGGGGSGAAAGVVVGSGGGRGAGGSRQGGQPGAQRMYKQSMAQRARTMALYNPIPVRQNCLTVNRSLFLFSEDNVDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25456 - protein, 2302 aa, Homo sapiens
  ENSP00000489992
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQFRKWKPSPLNIWYQHSAAGPPPAPPDPLHPPATRVLFPCDP

SEQ ID NO: 25457 - protein, 881 aa, Homo sapiens
  ENSP00000465598
VMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25458 - protein, 2266 aa, Homo sapiens
  ENSP00000490617
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 25459 - protein, 2512 aa, Homo sapiens
  ENSP00000489829
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25460 - protein, 2495 aa, Homo sapiens
  ENSP00000490223
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25461 - protein, 2507 aa, Homo sapiens
  ENSP00000490001
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25462 - protein, 2508 aa, Homo sapiens
  ENSP00000460092
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDVGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 25463 - protein, 2249 aa, Homo sapiens
  ENSP00000489777
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 25464 - protein, 2262 aa, Homo sapiens
  ENSP00000489715
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDVGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 25465 - protein, 550 aa, Homo sapiens
  ENSP00000490173
VMAFGILNYFRDAWNIFDFVTVLGSITDILVTEFGNPNNFINLSFLRLFRAARLIKLLRQGYTIRILLWTFVQSFKVFGNIGIDVEDEDSDEDEFQITEHNNFRTFFQALMLLFRSATGEAWHNIMLSCLSGKPCDKNSGILTRECGNEFAYFYFVSFIFLCSFLRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 25466 - protein, 2263 aa, Homo sapiens
  ENSP00000490578
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 25467 - protein, 75 aa, Homo sapiens
  ENSP00000490190
SFIFLCSFLMLNLFVAVIMDNFEYLTRDSSILGPHHLDEYVRVWAEYDPAACGFCGWTCPSQMTTPSTSIPPSWL

SEQ ID NO: 25468 - protein, 459 aa, Homo sapiens
  ENSP00000490686
DFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRME

SEQ ID NO: 25469 - protein, 26 aa, Homo sapiens
  ENSP00000490475
  MOD_RES (1)..(1): Any amino acid
XSITDILVTEFGNPAWSRATPPSPRS

SEQ ID NO: 25470 - protein, 79 aa, Homo sapiens
  ENSP00000460276
  MOD_RES (1)..(1): Any amino acid
XKFYGASVAYENALRVFNIVFTSLFSLECVLKVMAFGILNYFRDAWNIFDFVTVLGSITDILVTEFGAWSRATPPSPRS

SEQ ID NO: 25471 - protein, 44 aa, Homo sapiens
  ENSP00000490075
  MOD_RES (1)..(1): Any amino acid
XLNYFRDAWNIFDFVTVLGSITDILVTEFGNPAWSRATPPSPRS

SEQ ID NO: 25472 - protein, 212 aa, Homo sapiens
  ENSP00000489692
LLTLFTVSTGEGWPQVLKHSVDATFENQGPSPGYRMEMSIFYVVYFVVFPFFFVNIFVALIIITFQEQGDKMMEEYSLEKNENNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRE

SEQ ID NO: 25473 - protein, 103 aa, Homo sapiens
  ENSP00000459963
MSSWPTRPTKSTAPPRPGGKNGTTIIANCIVLALEQHLPDDDKTPMSERLDDTEPYFIGIFCFEAGIKIIALGFAFHKGSYLRNGWNVMDFVVVLTGILATVG

SEQ ID NO: 25474 - protein, 35 aa, Homo sapiens
  ENSP00000464729
MSSWPTRPTKSTAPPRPGGKNGRSYQRMCFTQTRE

SEQ ID NO: 25475 - protein, 2512 aa, Homo sapiens; identical to SEQ ID NO: 25459
  ENSP00000479983

SEQ ID NO: 25476 - protein, 2237 aa, Homo sapiens
  ENSP00000277551
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQAGSAVGFPNTTPCCRETPSASPWPLALELALTLTWGSVWTVRPLSTPCLRTLSLSRRLWPPTRAAPPGLPTCPP

SEQ ID NO: 25477 - protein, 2339 aa, Homo sapiens [sequence omitted]

SEQ ID NO: 25478 - protein, 2337 aa, Homo sapiens
  ENSP00000360414
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 25479 - protein, 2338 aa, Homo sapiens
  ENSP00000360408
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDAVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 25480 - protein, 164 aa, Homo sapiens
  ENSP00000413042
  MOD_RES (1)..(1): Any amino acid
XNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACCRIHYKDMYSLLRCIAPPVGLGKNCPRRLAYKRLVRMNMPISNEDMTVHFTSTLMALI

SEQ ID NO: 25481 - protein, 2237 aa, Homo sapiens [sequence omitted]

SEQ ID NO: 25482 - protein, 2340 aa, Homo sapiens
  ENSP00000360406
MVRFGDELGGRYGGPGGGERARGGGAGGAGGPGPGGLQPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCEGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDRNAEEKSPLDAVLKRAATKKSRNDLIHAEEGEDRFADLCAVGSPFARASLKSGKTESSSYFRRKEKMFRFFIRRMVKAQSFYWVVLCVVALNTLCVAMVHYNQPRRLTTTLYFAEFVFLGLFLTEMSLKMYGLGPRSYFRSSFNCFDFGVIVGSVFEVVWAAIKPGSSFGISVLRALRLLRIFKVTKYWSSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRFATTRHLRPDMKTHLDRPLVVELGRDGARGPVGGKARPEAAEAPEGVDPPRRHHRHRDKDKTPAAGDQDRAEAPKAESGEPGAREERPRPHRSHSKEAAGPPEARSERGRGPGPEGGRRHHRRGSPEEAAEREPRRHRAHRHQDPSKECAGAKGERRARHRGGPRAGPREAESGEEPARRHRARHKAQPAHEAVEKETTEKEATEKEAEIVEADKEKELRNHQPREPHCDLETSGTVTVGPMHTLPSTCLQKVEEQPEDADNQRNVTRMGSQPPDPNTIVHIPVMLTGPLGEATVVPSGNVDLESQAEGKKEVEADDVMRSGPRPIVPYSSMFCLSPTNLLRRFCHYIVTMRYFEVVILVVIALSSIALAAEDPVRTDSPRNNALKYLDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGYRMELSIFYVVYFVVFPFFFVNIFVALIIITFQEQGDKVMSECSLEKNERACIDFAISAKPLTRYMPQNRQSFQYKTWTFVVSPPFEYFIMAMIALNTVVLMMKFYDAPYEYELMLKCLNIVFTSMFSMECVLKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLSNQACDEQANATECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISVVWANLPQKTLDLLVPPHKPDEMTVGKVYAALMIFDFYKQNKTTRDQMQQAPGGLSQMGPVSLFHPLKATLEQTQPAVLRGARVFLRQKSSTSLSNGGAIQNQESGIKESVSWGTQRTQDAPHEARPPLERGHSTEIPVGRSGALAVDVQMQSITRRGPDGEPQPGLESQGRAASMPRLAAETQPVTDASPMKRSISTLAQRPRGTHLCSTTPDRPPPSQASSHHHHHRCHRRRDRKQRSLEKGPSLSADMDGAPSSAVGPGLPPGEGPTGCRRERERRQERGRSQERRQPSSSSSEKQRFYSCDRFGGREPPKPKPSLSSHPTSPTAGQEPGPHPQGSGSVNGSPLLSTSGASTPGRGGRRQLPQTPLTPRPSITYKTANSSPIHFAGAQTSLPAFSPGRLSRGLSEHNALLQRDPLSQPLAPGSRIGSDPYLGQRLDSEASVHALPEDTLTFEEAVATNSGRSSRTSYVSSLTSQSHPLRRVPNGYHCTLGLSSGGRARHSYHHPDQDHWC

SEQ ID NO: 25483 - protein, 2170 aa, Homo sapiens
  ENSP00000489769
MEMNLPTFSSDLIFIKSTMYQEIDARYKGKVISEAETKGYFSLAFGEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 25484 - protein, 2161 aa, Homo sapiens
  ENSP00000288133
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 25485 - protein, 1647 aa, Homo sapiens
  ENSP00000490039
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQMLERML

SEQ ID NO: 25486 - protein, 2181 aa, Homo sapiens
  ENSP00000288139
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 25487 - protein, 2137 aa, Homo sapiens
  ENSP00000409174
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 25488 - protein, 2146 aa, Homo sapiens
  ENSP00000490183
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 25489 - protein, 1643 aa, Homo sapiens
  ENSP00000491921
MQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKHYFTDAWNTFDALIVVGSVVDIAITEVNNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQMLERML

SEQ ID NO: 25490 - protein, 1372 aa, Homo sapiens
  ENSP00000490889
  MOD_RES (1)..(1): Any amino acid
XPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKHYFTDAWNTFDALIVVGSVVDIAITEVNPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGGQCSLFPK

SEQ ID NO: 25491 - protein, 264 aa, Homo sapiens
  ENSP00000418045
  MOD_RES (1)..(1): Any amino acid
XPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNRVTVADLLKEDKKKKKFCCFRQRRAKDHASMPTSETESVNTENVSGEGENRGCCGSLCQAISKSKLSRRWRRWNRFNRRRCRAAVKSVTFYWLVIVLVFLNTLTISSEHYNQPDW

SEQ ID NO: 25492 - protein, 1854 aa, Homo sapiens
  ENSP00000418014
ANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKHYFTDAWNTFDALIVVGSVVDIAITEVNPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 25493 - protein, 72 aa, Homo sapiens
  ENSP00000489962
EEEGGEEGKRNRVTVADLLKEDKKKKKFCCFRQRRAKDHASMPTSETESVNTENVSGEGENRGCCGSLWCWW

SEQ ID NO: 25494 - protein, 297 aa, Homo sapiens
  ENSP00000490108
  MOD_RES (1)..(1): Any amino acid
XADAESLNTAQKEEAEEKERKKIARKESLENKKNNKPEVNQIANSDNKVTIDDYREEDEDKDPYPPCDVPGEEEEEEEEDEPEVPAGPRPRRISELNMKEKIAPIPEGSAFFILSKTNPIRVGCHKLINHHIFTNLILVFIMLSSAALAAEDPIRSHSFRNTMLGYADYVFTGTFAFEIILKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNP

SEQ ID NO: 25495 - protein, 284 aa, Homo sapiens
  ENSP00000490908
  MOD_RES (1)..(1): Any amino acid
XFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKNSEESNRISITFFRLFRVMRLVKLLSRGEGIRTLLWTFIKSFQALPYVALLIAMLFFIYAV

SEQ ID NO: 25496 - protein, 490 aa, Homo sapiens
  ENSP00000489790
MMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQMLERML

SEQ ID NO: 25497 - protein, 223 aa, Homo sapiens
  ENSP00000490523
FFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYM

SEQ ID NO: 25498 - protein, 453 aa, Homo sapiens
  ENSP00000490839
  MOD_RES (1)..(1): Any amino acid
XVFTGVFTVEMVLKVIAFKPKHYFTDAWNTFDALIVVGSVVDIAITEVNPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKQEIRCVITIITIIP

SEQ ID NO: 25499 - protein, 438 aa, Homo sapiens
  ENSP00000432038
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSV

SEQ ID NO: 25500 - protein, 2270 aa, Homo sapiens
  ENSP00000356542
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 25501 - protein, 2251 aa, Homo sapiens
  ENSP00000481619
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 25502 - protein, 2294 aa, Homo sapiens
  ENSP00000353222
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 25503 - protein, 2313 aa, Homo sapiens
  ENSP00000356545
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 25504 - protein, 2312 aa, Homo sapiens [sequence omitted]

SEQ ID NO: 25505 - protein, 2270 aa, Homo sapiens; identical to SEQ ID NO: 25500
  ENSP00000356539

SEQ ID NO: 25506 - protein, 2313 aa, Homo sapiens; identical to SEQ ID NO: 25503
  ENSP00000483914

SEQ ID NO: 25507 - protein, 2251 aa, Homo sapiens; identical to SEQ ID NO: 25501
  ENSP00000351101

SEQ ID NO: 25508 - protein, 2261 aa, Homo sapiens
  ENSP00000353990
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25509 - protein, 2250 aa, Homo sapiens
  ENSP00000339302
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25510 - protein, 2243 aa, Homo sapiens
  ENSP00000409759
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25511 - protein, 1555 aa, Homo sapiens
  ENSP00000392390
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQVSPRLRGGAVVKEAGGGTGPCLVIPADSGGGGLHEEISPSHPLLSNHQHVAKPSPSHSAPKSGPMGSLAVLKDEETEAQRG

SEQ ID NO: 25512 - protein, 2306 aa, Homo sapiens
  ENSP00000425522
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25513 - protein, 2273 aa, Homo sapiens
  ENSP00000426261
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25514 - protein, 2239 aa, Homo sapiens
  ENSP00000425451
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25515 - protein, 2227 aa, Homo sapiens
  ENSP00000422407
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25516 - protein, 2232 aa, Homo sapiens
  ENSP00000426814
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25517 - protein, 2250 aa, Homo sapiens
  ENSP00000427238
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25518 - protein, 2332 aa, Homo sapiens
  ENSP00000423112
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25519 - protein, 1758 aa, Homo sapiens
  ENSP00000427247
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 25520 - protein, 2366 aa, Homo sapiens
  ENSP00000420918
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25521 - protein, 1776 aa, Homo sapiens
  ENSP00000426313
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 25522 - protein, 1765 aa, Homo sapiens
  ENSP00000425153
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 25523 - protein, 2287 aa, Homo sapiens
  ENSP00000426172
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25524 - protein, 2277 aa, Homo sapiens
  ENSP00000423045
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25525 - protein, 1753 aa, Homo sapiens
  ENSP00000427231
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 25526 - protein, 2298 aa, Homo sapiens
  ENSP00000427173
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25527 - protein, 2284 aa, Homo sapiens
  ENSP00000426098
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25528 - protein, 2259 aa, Homo sapiens
  ENSP00000425698
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25529 - protein, 2321 aa, Homo sapiens
  ENSP00000426232
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25530 - protein, 2291 aa, Homo sapiens
  ENSP00000423317
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMADLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25531 - protein, 2194 aa, Homo sapiens
  ENSP00000421518
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25532 - protein, 1746 aa, Homo sapiens
  ENSP00000424664
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTLWAWSSLETWSVTRHTPVRAWAVMPPFGTLAWPS

SEQ ID NO: 25533 - protein, 2205 aa, Homo sapiens
  ENSP00000422268
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25534 - protein, 1735 aa, Homo sapiens
  ENSP00000426558
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 25535 - protein, 2314 aa, Homo sapiens
  ENSP00000423155
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25536 - protein, 2266 aa, Homo sapiens
  ENSP00000414388
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25537 - protein, 2377 aa, Homo sapiens
  ENSP00000352011
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25538 - protein, 2171 aa, Homo sapiens
  ENSP00000350979
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25539 - protein, 277 aa, Homo sapiens
  ENSP00000459988
AFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIFLALRTSPVERASII

SEQ ID NO: 25540 - protein, 337 aa, Homo sapiens
  ENSP00000427697
TASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQVGLRWAGSICGLRSLSMG

SEQ ID NO: 25541 - protein, 2343 aa, Homo sapiens
  ENSP00000347078
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 25542 - protein, 1091 aa, Homo sapiens
  ENSP00000349320
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 25543 - protein, 280 aa, Homo sapiens
  ENSP00000409374
  MOD_RES (1)..(1): Any amino acid
XKRLTPRFTLCPNGYYFAIDPNGYVLLHPNLQPKPIGVGIPTINLRKRRPNIQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFN

SEQ ID NO: 25544 - protein, 309 aa, Homo sapiens
  ENSP00000405395
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASDSKEISPSPEEIFNAE

SEQ ID NO: 25545 - protein, 1103 aa, Homo sapiens
  ENSP00000348589
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKPIGVGIPTINLRKRRPNIQNPKSQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 25546 - protein, 1153 aa, Homo sapiens
  ENSP00000407393
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKLPISKLKDFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKQCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 25547 - protein, 1144 aa, Homo sapiens
  ENSP00000404631
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKQCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 25548 - protein, 1145 aa, Homo sapiens
  ENSP00000266039
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 25549 - protein, 1076 aa, Homo sapiens
  ENSP00000354228
MQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 25550 - protein, 1143 aa, Homo sapiens
  ENSP00000390329
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 25551 - protein, 1150 aa, Homo sapiens
  ENSP00000418081
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKLPISKLKDFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 25552 - protein, 1091 aa, Homo sapiens
  ENSP00000419101
MAGPGSPRRASRGASALLAAALLYAALGDVVRSEQQIPLSVVKLWASAFGGEIKSIAAKYSGSQLLQKKYKEYEKDVAIEEIDGLQLVKKLAKNMEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 25553 - protein, 997 aa, Homo sapiens
  ENSP00000417279
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 25554 - protein, 519 aa, Homo sapiens
  ENSP00000418228
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGFRCGAFQRSWEIFLPRECNHRRRPA

SEQ ID NO: 25555 - protein, 525 aa, Homo sapiens
  ENSP00000417318
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGFRCGAFQRSWEIFLPRECNHRRRPA

SEQ ID NO: 25556 - protein, 126 aa, Homo sapiens
  ENSP00000418028
MEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGF

SEQ ID NO: 25557 - protein, 46 aa, Homo sapiens
  ENSP00000417455
MEEMFHKKSEAVRRLVEAAEEAHLKHEFDADLQTLQLSMGFIGLNL

SEQ ID NO: 25558 - protein, 1091 aa, Homo sapiens; identical to SEQ ID NO: 25552
  ENSP00000389506

SEQ ID NO: 25559 - protein, 519 aa, Homo sapiens; identical to SEQ ID NO: 25554
  ENSP00000478969

SEQ ID NO: 25560 - protein, 1091 aa, Homo sapiens; identical to SEQ ID NO: 25552
  ENSP00000288197

SEQ ID NO: 25561 - protein, 151 aa, Homo sapiens
  ENSP00000449389
MEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLGGTCSPI

SEQ ID NO: 25562 - protein, 471 aa, Homo sapiens
  ENSP00000445495
MEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 25563 - protein, 483 aa, Homo sapiens
  ENSP00000444160
MSFSDSSATFLLNEGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 25564 - protein, 105 aa, Homo sapiens
  ENSP00000446611
MSFSDSSATFLLNEGSADSYTSRPSLDSDVSLEEDRESARREVESQAQQQLERAKHKPVAFAVRTNVSYCGVLDEECPVQGSGVNFEAKDFLHIKEEIWEPFQPE

SEQ ID NO: 25565 - protein, 55 aa, Homo sapiens
  ENSP00000448074
MRPVVLVGPSLKGYEVTDMMQKALFDFLKHRFDGRISITRVTADLSLAKRSVLNN

SEQ ID NO: 25566 - protein, 122 aa, Homo sapiens
  ENSP00000448137
MRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPK

SEQ ID NO: 25567 - protein, 457 aa, Homo sapiens
  ENSP00000446529
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 25568 - protein, 484 aa, Homo sapiens
  ENSP00000301050
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 25569 - protein, 144 aa, Homo sapiens
  ENSP00000449497
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEYSNDWWIGRLVKEGGDIAFIPSPQRLESIRLKQEQKARRSGNPSSLS

SEQ ID NO: 25570 - protein, 443 aa, Homo sapiens
  ENSP00000448304
MYDDSYVPGFEDSEAGSADSYTSRPSLDSDVSLEEDRESARREVESQAQQQLERAKKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 25571 - protein, 37 aa, Homo sapiens
  ENSP00000447462
MYDDSYVPGFEDSEAPPAEASSAAGILSSCPAWRAWR

SEQ ID NO: 25572 - protein, 84 aa, Homo sapiens
  ENSP00000447261
QQLERAKHKPVAFAVRTNVSYCGVLDEECPVQGSGVNFEAKDFLHIKENLGGPPCLSHSFALHPVISVLVPHTSLENRAPDFVP

SEQ ID NO: 25573 - protein, 76 aa, Homo sapiens
  ENSP00000448076
  MOD_RES (1)..(1): Any amino acid
XKDFLHIKEKYSNDWWIGRLVKEGGDIAFIPSPQRLESIRLKQEQKARRSGNPSSLSDIGNRRSPPPSLGGTCSPI

SEQ ID NO: 25574 - protein, 520 aa, Homo sapiens
  ENSP00000438949
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25575 - protein, 307 aa, Homo sapiens
  ENSP00000490124
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25576 - protein, 392 aa, Homo sapiens
  ENSP00000490145
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25577 - protein, 180 aa, Homo sapiens
  ENSP00000489881
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVDFNNESDS

SEQ ID NO: 25578 - protein, 411 aa, Homo sapiens
  ENSP00000490607
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25579 - protein, 473 aa, Homo sapiens
  ENSP00000490250
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25580 - protein, 256 aa, Homo sapiens
  ENSP00000490127
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRVSE

SEQ ID NO: 25581 - protein, 452 aa, Homo sapiens
  ENSP00000489621
MYDNLYLHGIEDSEAGSADSYTSRPSDSDVSLEEDREAIRQEREQQAAIQLERAKKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVHVFFYQVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25582 - protein, 473 aa, Homo sapiens; identical to SEQ ID NO: 25579
  ENSP00000490247

SEQ ID NO: 25583 - protein, 407 aa, Homo sapiens
  ENSP00000490660
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25584 - protein, 113 aa, Homo sapiens
  ENSP00000489915
  MOD_RES (1)..(1): Any amino acid
XKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPSANEAQQPLHRELSN

SEQ ID NO: 25585 - protein, 502 aa, Homo sapiens
  ENSP00000489677
MDVVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25586 - protein, 194 aa, Homo sapiens
  ENSP00000490252
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEDFNNESDS

SEQ ID NO: 25587 - protein, 145 aa, Homo sapiens
  ENSP00000490138
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKCLMLYWMKISLRMHVNI

SEQ ID NO: 25588 - protein, 80 aa, Homo sapiens
  ENSP00000489953
MVSGTFRATPTSTAKQKQKVTEHIPPYDVVPSMRPVVLVGPSLKGYERKYKVKLKESLSWQDLCNWLFLMQTPSITQHNL

SEQ ID NO: 25589 - protein, 461 aa, Homo sapiens
  ENSP00000489779
MDVVARGTTTRRSRLKRSDGSTTSTSFILRQGSADSYTSRPSDSDVSLEEDREAIRQEREQQAAIQLERAKKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25590 - protein, 363 aa, Homo sapiens
  ENSP00000489788
MDVVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25591 - protein, 424 aa, Homo sapiens
  ENSP00000489967
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25592 - protein, 411 aa, Homo sapiens; identical to SEQ ID NO: 25578
  ENSP00000489818

SEQ ID NO: 25593 - protein, 219 aa, Homo sapiens
  ENSP00000490651
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYERKYKVKLKESLSWQDLCNWLFLMQTPSITQHNL

SEQ ID NO: 25594 - protein, 490 aa, Homo sapiens
  ENSP00000489876
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGLFVASLVSWYLGEDSFRKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25595 - protein, 158 aa, Homo sapiens
  ENSP00000489943
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKCLMLYWMKISLRMHVNI

SEQ ID NO: 25596 - protein, 202 aa, Homo sapiens
  ENSP00000490144
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTDGAHSSLRCCTVNASGGVSGAVTERLRGNRHDAESPL

SEQ ID NO: 25597 - protein, 48 aa, Homo sapiens
  ENSP00000489746
MYDNLYLHGIEDSEALTKQLGVGRISKTEIGLLSDPNGFSGFLHKQAV

SEQ ID NO: 25598 - protein, 194 aa, Homo sapiens
  ENSP00000490918
MDVVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTEFTYFDMALVIVF

SEQ ID NO: 25599 - protein, 486 aa, Homo sapiens
  ENSP00000443893
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25600 - protein, 334 aa, Homo sapiens
  ENSP00000489787
MVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25601 - protein, 473 aa, Homo sapiens; identical to SEQ ID NO: 25579
  ENSP00000390161

SEQ ID NO: 25602 - protein, 445 aa, Homo sapiens
  ENSP00000489679
MYDNLYLHGIEDSEAGSADSYTSRPSDSDVSLEEDREAIRQEREQQAAIQLERAKKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25603 - protein, 441 aa, Homo sapiens
  ENSP00000380490
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25604 - protein, 38 aa, Homo sapiens
  ENSP00000490817
MYDNLYLHGIEDSEANNVMCYPRWCEQSFKPMEKTRPK

SEQ ID NO: 25605 - protein, 410 aa, Homo sapiens
  ENSP00000489883
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTDGAHSSLRCCTVNASGGVSGAVTERLRAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25606 - protein, 479 aa, Homo sapiens
  ENSP00000410978
MSSSSYAKNGTADGPHSPTSQVARGTTTRRSRLKRSDGSTTSTSFILRQGSADSYTSRPSDSDVSLEEDREAIRQEREQQAAIQLERAKKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25607 - protein, 272 aa, Homo sapiens
  ENSP00000490795
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYESQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25608 - protein, 232 aa, Homo sapiens
  ENSP00000490572
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYERKYKVKLKESLSWQDLCNWLFLMQTPSITQHNL

SEQ ID NO: 25609 - protein, 423 aa, Homo sapiens
  ENSP00000489732
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTDGAHSSLRCCTVNASGGVSGAVTERLRAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25610 - protein, 351 aa, Homo sapiens
  ENSP00000490488
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAEVQSEIERIFELARSLQLVVLDADTINHPAQLIKTSLAPIIVHVKVSSPKEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25611 - protein, 334 aa, Homo sapiens
  ENSP00000490176
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25612 - protein, 232 aa, Homo sapiens; identical to SEQ ID NO: 25608
  ENSP00000490891

SEQ ID NO: 25613 - protein, 207 aa, Homo sapiens
  ENSP00000490510
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEDFNNESDS

SEQ ID NO: 25614 - protein, 215 aa, Homo sapiens
  ENSP00000490430
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYESWKCQRDEQESGLQKSSHGHGEFPPTYTN

SEQ ID NO: 25615 - protein, 472 aa, Homo sapiens
  ENSP00000353425
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25616 - protein, 334 aa, Homo sapiens; identical to SEQ ID NO: 25600
  ENSP00000490304

SEQ ID NO: 25617 - protein, 168 aa, Homo sapiens
  ENSP00000490501
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTGFQ

SEQ ID NO: 25618 - protein, 80 aa, Homo sapiens; identical to SEQ ID NO: 25588
  ENSP00000490298

SEQ ID NO: 25619 - protein, 110 aa, Homo sapiens
  ENSP00000489772
  MOD_RES (1)..(1): Any amino acid
XDAKDFLHIKEKYNNDWWIGRLVKEGCEIGFIPSPLRLENIRIQQEQKRGRFHGGKSSGNSSSSLGEMVSGTFRATPTSTDGAHSSLRCCTVNASGGVSGAVTERLRGNV

SEQ ID NO: 25620 - protein, 393 aa, Homo sapiens
  ENSP00000490443
MAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQRKLPRD

SEQ ID NO: 25621 - protein, 458 aa, Homo sapiens
  ENSP00000201943
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 25622 - protein, 341 aa, Homo sapiens
  ENSP00000490910
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKEMFDVILDENQLEDACEHLGEYLEAYWRATHTTSS

SEQ ID NO: 25623 - protein, 79 aa, Homo sapiens
  ENSP00000490603
  MOD_RES (1)..(1): Any amino acid
XPSPLRLENIRIQQEQKRGRFHGGKSSGNSSSSLGEMVSGTFRATPTSTDGAHSSLRCCTVNASGGVSGAVTERLRGFQ

SEQ ID NO: 25624 - protein, 307 aa, Homo sapiens
  ENSP00000490337
MYDNLYLHGIEDSEAGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVQISSVTLQFLIEHPGDSHVDACSSRVCFHVGPDGSQCSAWEGRGYRVGLMRPSALSFLSCTLLIFYVLHCLEIPPSKYSQWEDLVKDLLYIKCKEKDFICLDHSHYY

SEQ ID NO: 25625 - protein, 323 aa, Homo sapiens
  ENSP00000489912
MDVVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVQISSVTLQFLIEHPGDSHVDACSSRVCFHVGPDGSQCSAWEGRGYRVGLMRPSALSFLSCTLLIFYVLHCLEIPPSKYSQWEDLVKDLLYIKCKEKDFICLDHSHYY

SEQ ID NO: 25626 - protein, 124 aa, Homo sapiens
  ENSP00000490787
  MOD_RES (1)..(1): Any amino acid
XDFLHIKEKYNNDWWIGRLVKEGCEIGFIPSPLRLENIRIQQEQKRGRFHGGKSSGNSSSSLGEMVSGTFRATPTSTDGAHSSLRCCTVNASGGVSGAVTERLRGTNIICYSSVLDRAPRRQSC

SEQ ID NO: 25627 - protein, 125 aa, Homo sapiens
  ENSP00000399242
MAGSADSYTSRPSDSDVSLEEDREAIRQEREQQAAIQLERAKKYNNDWWIGRLVKEGCEIGFIPSPLRLENIRIQQEQKRGRFHGGKSSGNSSSSLGEMVSGTFRATPTSTAKQKQKVTEHIPPY

SEQ ID NO: 25628 - protein, 40 aa, Homo sapiens
  ENSP00000490249
MAGSADSYTSRPSDSDVSLEEDREAIRQEREQQAAIQLER

SEQ ID NO: 25629 - protein, 315 aa, Homo sapiens
  ENSP00000005284
MRMCDRGIQMLITTVGAFAAFSLMTIAVGTDYWLYSRGVCRTKSTSDNETSRKNEEVMTHSGLWRTCCLEGAFRGVCKKIDHFPEDADYEQDTAEYLLRAVRASSVFPILSVTLLFFGGLCVAASEFHRSRHNVILSAGIFFVSAGLSNIIGIIVYISANAGDPGQRDSKKSYSYGWSFYFGAFSFIIAEIVGVVAVHIYIEKHQQLRAKSHSEFLKKSTFARLPPYRYRFRRRSSSRSTEPRSRDLSPISKGFHTIPSTDISMFTLSRDPSKITMGTLLNSDRDHAFLQFHNSTPKEFKESLHNNPANRRTTPV

SEQ ID NO: 25630 - protein, 327 aa, Homo sapiens
  ENSP00000262138
MVRCDRGLQMLLTTAGAFAAFSLMAIAIGTDYWLYSSAHICNGTNLTMDDGPPPRRARGDLTHSGLWRVCCIEGIYKGHCFRINHFPEDNDYDHDSSEYLLRIVRASSVFPILSTILLLLGGLCIGAGRIYSRKNNIVLSAGILFVAAGLSNIIGIIVYISSNTGDPSDKRDEDKKNHYNYGWSFYFGALSFIVAETVGVLAVNIYIEKNKELRFKTKREFLKASSSSPYARMPSYRYRRRRSRSSSRSTEASPSRDVSPMGLKITGAIPMGELSMYTLSREPLKVTTAASYSPDQEASFLQVHDFFQQDLKEGFHVSMLNRRTTPV

SEQ ID NO: 25631 - protein, 275 aa, Homo sapiens
  ENSP00000436836
MSACGRKALTLLSSVFAVCGLGLLGIAVSTDYWLYLEEGVIVPQNQSTEIKMSLHSGLWRVCFLAGEERGRCFTIEYVMPMNTQLTSESTVNVLKMIRSATPFPLVSLFFMFIGFILNNIGHIRPHRTILAFVSGIFFILSGLSLVVGLVLYISSINDEMLNRTKDAETYFNYKYGWSFAFAAISFLLTESAGVMSVYLFMKRYTAEDMYRPHPGFYRPRLSNCSDYSGQFLHPDAWVRGRSPSDISSEASLQMNSNYPALLKCPDYDQMSSSPC

SEQ ID NO: 25632 - protein, 275 aa, Homo sapiens; identical to SEQ ID NO: 25631
  ENSP00000303092

SEQ ID NO: 25633 - protein, 425 aa, Homo sapiens
  ENSP00000270458
LESLKRWNEERGLWCEKGVQVLLTTVGAFAAFGLMTIAISTDYWLYTRALICNTTNLTAGGDDGTPHRGGGGASEKKDPGGLTHSGLWRICCLEGLKRGVCVKINHFPEDTDYDHDSAEYLLRVVRASSIFPILSAILLLLGGVCVAASRVYKSKRNIILGAGILFVAAGLSNIIGVIVYISANAGEPGPKRDEEKKNHYSYGWSFYFGGLSFILAEVIGVLAVNIYIERSREAHCQSRSDLLKAGGGAGGSGGSGPSAILRLPSYRFRYRRRSRSSSRSSEPSPSRDASPGGPGGPGFASTDISMYTLSRDPSKGSVAAGLAGAGGGGGGAVGAFGGAAGGAGGGGGGGGGAGAERDRGGASGFLTLHNAFPKEAGGGVTVTVTGPPAPPAPAPPAPSAPAPGTLAKEAAASNTNTLNRKTTPV

SEQ ID NO: 25634 - protein, 425 aa, Homo sapiens
  ENSP00000492637
MESLKRWNEERGLWCEKGVQVLLTTVGAFAAFGLMTIAISTDYWLYTRALICNTTNLTAGGDDGTPHRGGGGASEKKDPGGLTHSGLWRICCLEGLKRGVCVKINHFPEDTDYDHDSAEYLLRVVRASSIFPILSAILLLLGGVCVAASRVYKSKRNIILGAGILFVAAGLSNIIGVIVYISANAGEPGPKRDEEKKNHYSYGWSFYFGGLSFILAEVIGVLAVNIYIERSREAHCQSRSDLLKAGGGAGGSGGSGPSAILRLPSYRFRYRRRSRSSSRSSEPSPSRDASPGGPGGPGFASTDISMYTLSRDPSKGSVAAGLAGAGGGGGGAVGAFGGAAGGAGGGGGGGGGAGAERDRGGASGFLTLHNAFPKEAGGGVTVTVTGPPAPPAPAPPAPSAPAPGTLAKEAAASNTNTLNRKTTPV

SEQ ID NO: 25635 - protein, 185 aa, Homo sapiens
  ENSP00000479414
MQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 25636 - protein, 50 aa, Homo sapiens
  ENSP00000403674
MASEELQKDLEEVKVLLEKATRKRVRDALTAEKSKIETEIKNKMQQKSQK

SEQ ID NO: 25637 - protein, 228 aa, Homo sapiens
  ENSP00000356652
MASEELQKDLEEVKVLLEKATRKRVRDALTAEKSKIETEIKNKMQQKSQKKAELLDNEKPAAVVAPITTGYTVKISNYGWDQSDKFVKIYITLTGVHQVPTENVQVHFTERSFDLLVKNLNGKSYSMIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDTEF

SEQ ID NO: 25638 - protein, 80 aa, Homo sapiens
  ENSP00000384139
MASEELQKDLEEVKVLLEKATRKRVRDALTAEKSKIETEIKNKMQQKSQKKAELLDNEKPAAVVAPITTGYTDGISQISL

SEQ ID NO: 25639 - protein, 185 aa, Homo sapiens; identical to SEQ ID NO: 25635
  ENSP00000385771

SEQ ID NO: 25640 - protein, 432 aa, Homo sapiens
  ENSP00000357106
MGAPAASLLLLLLLFACCWAPGGANLSQDGYWQEQDLELGTLAPLDEAISSTVWSSPDMLASQDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 25641 - protein, 398 aa, Homo sapiens
  ENSP00000357107
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 25642 - protein, 234 aa, Homo sapiens
  ENSP00000387802
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNDTPTAMIRPDPPHPREGQKLLLHCEGRGNPVPQQYLWEKEGSVPPLKMTQ

SEQ ID NO: 25643 - protein, 1353 aa, Homo sapiens
  ENSP00000373215
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENQKDAENVGRLITPAKKLEDTIRLAELVIEVLQQNEEHHAEPHVDKGEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVKSLTSNLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 25644 - protein, 345 aa, Homo sapiens
  ENSP00000418889
  MOD_RES (1)..(1): Any amino acid
XLPNVNLPNVNLPKVPNLPVNIPLGIPQMPTFSAPSWMAAIYDADNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEFAKMWHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 25645 - protein, 1274 aa, Homo sapiens
  ENSP00000350632
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 25646 - protein, 1314 aa, Homo sapiens
  ENSP00000283269
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEGKKREMYEHPVFCLASQVMDLTIQNVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 25647 - protein, 190 aa, Homo sapiens
  ENSP00000417568
  MOD_RES (1)..(1): Any amino acid
XKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTKPGMDVADAYVTFVRHSQDVLRDKVNEEMYIERLFDQWYNSSMNVICTWLTDRMDLQLHIYQLKTL

SEQ ID NO: 25648 - protein, 311 aa, Homo sapiens
  ENSP00000418110
  MOD_RES (1)..(1): Any amino acid
XNDSYSCLGWFSPGQVFVLDEYCARNGVRGCHRHLCYLRDLLERAENGAMIDPTLLHYSFAFCASHVHGNRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENQKDAENVGRLITPAKKLEDTIRLAELVIEVLQQNEEHHAEGKEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPV

SEQ ID NO: 25649 - protein, 240 aa, Homo sapiens
  ENSP00000417827
  MOD_RES (1)..(1): Any amino acid
XADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNSQQMHVYLSGLPPNTDPEGSKTPSPPEPEAKKDTKKESKKRKDSKTQANQELKRPDGIGTVTVEEKERFEEIKERLRVLLENQITHFRYCFPFGRPEGALKATLSLLERVLMKDIVTPVPQEEVKTVIRKCL

SEQ ID NO: 25650 - protein, 212 aa, Homo sapiens
  ENSP00000439528
QDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFSGLKDADRAQKHGMDEFISSNPCNFDHASLFEMVQRLTLDHRLNDSYSCLGWFSPGQVFVLD

SEQ ID NO: 25651 - protein, 457 aa, Homo sapiens
  ENSP00000418736
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTVIRRNRREQLPHSAI

SEQ ID NO: 25652 - protein, 222 aa, Homo sapiens
  ENSP00000482556
MFNVMVDAKAQSTKLCSMEMGQEFAKMWHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 25653 - protein, 1344 aa, Homo sapiens
  ENSP00000484365
MLDPSSSEEESDEIVEEESGKEVLGSAPSGARLSPSRTSEGSAGSAGLGGGGAGAGAGVGAGGGGGSGASSGGGAGGLQPSSRAGGGRPSSPSPSVVSEKEKEELERLQKEEEERKKRLQLYVFVMRCIAYPFNAKQPTDMARRQQKISKQQLQTVKDRFQAFLNGETQIMADEAFMNAVQSYYEVFLKSDRVARMVQSGGCSANDSREVFKKHIEKRVRSLPEIDGLSKETVLSSWMAKFDAIYRGEEDPRKQQARMTASAASELILSKEQLYEMFQNILGIKKFEHQLLYNACQLDNPDEQAAQIRRELDGRLQMADQIARERKFPKFVSKEMENMYIEELKSSVNLLMANLESMPVSKGGEFKLQKLKRSHNASIIDMGEESENQLSKSDVVLSFSLEVVIMEVQGLKSLAPNRIVYCTMEVEGGEKLQTDQAEASKPTWGTQGDFSTTHALPAVKVKLFTESTGVLALEDKELGRVILHPTPNSPKQSEWHKMTVSKNCPDQDLKIKLAVRMDKPQNMKHSGYLWAIGKNVWKRWKKRFFVLVQVSQYTFAMCSYREKKAEPQELLQLDGYTVDYTDPQPGLEGGRAFFNAVKEGDTVIFASDDEQDRILWVQAMYRATGQSHKPVPPTQVQKLNAKGGNVPQLDAPISQFYADRAQKHGMDEFISSNPCNFDHASLFEMVQRLTLDHRLNDSYSCLGWFSPGQVFVLDEYCARNGVRGCHRHLCYLRDLLERAENGAMIDPTLLHYSFAFCASHVHGNSQQMHVYLSGLPPNTDPEGSKTPSPPEPEAKKDTKKESKKRKDSKTQANQELKRPDGIGTVTVEEKERFEEIKERLRVLLENQITHFRYCFPFGRPEGALKATLSLLERVLMKDIVTPVPQEEVKTVIRKCLEQAALVNYSRLSEYAKIEENVGRLITPAKKLEDTIRLAELVIEVLQQNEEHHAEAFAWWSDLMVEHAETFLSLFAVDMDAALEVQPPDTWDSFPLFQLLNDFLRTDYNLCNGKFHKHLQDLFAPLVVRYVDLMESSIAQSIHRGFERESWEPVNNGSGTSEDLFWKLDALQTFIRDLHWPEEEFGKHLEQRLKLMASDMIESCVKRTRIAFEVKLQKTSRSTDFRVPQSICTMFNVMVDAKAQSTKLCSMEMGQEHQYHSKIDELIEETVKEMITLLVAKFVTILEGVLAKLSRYDEGTLFSSFLSFTVKAASKYVDVPKPGMDVADAYVTFVRHSQDVLRDKVNEEMYIERLFDQWYNSSMNVICTWLTDRMDLQLHIYQLKTLIRMVKKTYRDFRLQGVLDSTLNSKTYETIRNRLTVEEATASVSEGGGLQGISMKDSDEEDEEDD

SEQ ID NO: 25654 - protein, 490 aa, Homo sapiens
  ENSP00000419418
  MOD_RES (1)..(1): Any amino acid
XYTRLTEYAKIEGPAEKETETMNQASPARKLEEILHLAELCIEVLQQNEEHHAEGREAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 25655 - protein, 1255 aa, Homo sapiens
  ENSP00000400401
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEFGSQWQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 25656 - protein, 1296 aa, Homo sapiens
  ENSP00000398481
MLDPSSSEEESDEGLEEESRDVLVAAGSSQRAPPAPTREGRRDAPGRAGGGGAARSVSPSPSVLSEGRDEPQRQLDDEQERRIRLQLYVFVVRCIAYPFNAKQPTDMARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLSGKDADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEGREAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 25657 - protein, 899 aa, Homo sapiens
  ENSP00000380833
  MOD_RES (1)..(1): Any amino acid
XEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLYADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVNNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 25658 - protein, 1294 aa, Homo sapiens [sequence omitted]

SEQ ID NO: 25659 - protein, 1301 aa, Homo sapiens [sequence omitted]

SEQ ID NO: 25660 - protein, 1194 aa, Homo sapiens
  ENSP00000325581
MARRQQKLNKQQLQLLKERFQAFLNGETQIVADEAFCNAVRSYYEVFLKSDRVARMVQSGGCSANDFREVFKKNIEKRVRSLPEIDGLSKETVLSSWIAKYDAIYRGEEDLCKQPNRMALSAVSELILSKEQLYEMFQQILGIKKLEHQLLYNACQLDNADEQAAQIRRELDGRLQLADKMAKERKFPKFIAKDMENMYIEELRSSVNLLMANLESLPVSKGGPEFKLQKLKRSQNSAFLDIGDENEIQLSKSDVVLSFTLEIVIMEVQGLKSVAPNRIVYCTMEVEGEKLQTDQAEASRPQWGTQGDFTTTHPRPVVKVKLFTESTGVLALEDKELGRVILYPTSNSSKSAELHRMVVPKNSQDSDLKIKLAVRMDKPAHMKHSGYLYALGQKVWKRWKKRYFVLVQVSQYTFAMCSYREKKSEPQELMQLEGYTVDYTDPHPGLQGGCMFFNAVKEGDTVIFASDDEQDRILWVQAMYRATGQSYKPVPAIQTQKLNPKGGTLHADAQLSGKDADRFQKHGMDEFISANPCKLDHAFLFRILQRQTLDHRLNDSYSCLGWFSPGQVFVLDEYCARYGVRGCHRHLCYLAELMEHSENGAVIDPTLLHYSFAFCASHVHGNRPDGIGTVSVEEKERFEEIKERLSSLLENQISHFRYCFPFGRPEGALKATLSLLERVLMKDIATPIPAEEVKKVVRKCLEKAALINYTRLTEYAKIEGPAEKETETMNQASPARKLEEILHLAELCIEVLQQNEEHHAEAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 25661 - protein, 261 aa, Homo sapiens
  ENSP00000265431
MAESHLQSSLITASQFFEIWLHFDADGSGYLEGKELQNLIQELQQARKKAGLELSPEMKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 25662 - protein, 204 aa, Homo sapiens
  ENSP00000429602
MKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQENFLLKFQGIKMCGKEFNKAFELYDQDGNGYIDENELDALLKDLCEKNKQDLDINNITTYKKNIMALSDGGKLYRTDLALILCAGDN

SEQ ID NO: 25663 - protein, 119 aa, Homo sapiens
  ENSP00000429246
MKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNNDGKLELTEMARLLPVQEN

SEQ ID NO: 25664 - protein, 102 aa, Homo sapiens
  ENSP00000430281
MKTFVDQYGQRDDGKIGIVELAHVLPTEENFLLLFRCQQLKSCEEFMKTWRKYDTDHSGFIETEELKNFLKDLLEKANKTVDDTKLAEYTDLMLKLFDSNND

SEQ ID NO: 25665 - protein, 3 aa, Homo sapiens
  ENSP00000430192
MKT

SEQ ID NO: 25666 - protein, 271 aa, Homo sapiens
  ENSP00000307508
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKDRSGYIDEHELDALLKDLYEKNKKEMNIQQLTNYRKSVMSLAEAGKLYRKDLEIVLCSEPPM

SEQ ID NO: 25667 - protein, 235 aa, Homo sapiens
  ENSP00000454639
  MOD_RES (1)..(1): Any amino acid
XAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRLLPVQENFLLKFQGMKLTSEEFNAIFTFYDKEMNIQQLTNYRKSVMSLAEAGKLYRK

SEQ ID NO: 25668 - protein, 158 aa, Homo sapiens
  ENSP00000454467
  MOD_RES (1)..(1): Any amino acid
XLENFFQELEKARKGSGMLAQILPTEENFLLCFRQHVGSSAEFMEAWRKYDTDRSGYIEANELKGFLSDLLKKANRPYDEPKLQEYTQTILRMFDLNGDGKLGLSEILLPVQENFLLKFQGMKLTSEEFNAIFTFYDKDRSGYIDEHELDALLKDLYE

SEQ ID NO: 25669 - protein, 192 aa, Homo sapiens
  ENSP00000340294
MAGPQQQPPYLHLAELTASQFLEIWKHFDADGNGYIEGKELENFFQELEKARKGSGMMSKSDNFGEKMKEFMQKYDKNSDGKIEMAELAQILPTEENFLLCFRQHVGSSAEFMEAWRKYDTDRSGYIEANELKGFLSDLLKKANRPYDEPKLQEYTQTILRMFDLNGDGKLGLSEMSRIEAATLTSMSWMPF

SEQ ID NO: 25670 - protein, 192 aa, Homo sapiens; identical to SEQ ID NO: 25669
  ENSP00000489007

SEQ ID NO: 25671 - protein, 271 aa, Homo sapiens; identical to SEQ ID NO: 25666
  ENSP00000488916

SEQ ID NO: 25672 - protein, 235 aa, Homo sapiens; identical to SEQ ID NO: 25667
  ENSP00000489176
  MOD_RES (1)..(1): Any amino acid

SEQ ID NO: 25673 - protein, 158 aa, Homo sapiens; identical to SEQ ID NO: 25668
  ENSP00000489458
  MOD_RES (1)..(1): Any amino acid

SEQ ID NO: 25674 - protein, 461 aa, Homo sapiens [sequence omitted]

SEQ ID NO: 25675 - protein, 461 aa, Homo sapiens [sequence omitted]

SEQ ID NO: 25676 - protein, 461 aa, Homo sapiens [sequence omitted]

SEQ ID NO: 25677 - protein, 77 aa, Homo sapiens
  ENSP00000415626
MEKKCTLYFLVLLPFFMILVTAELEESPEDSIQLGVTRNKIMTAQYECYQKIMQDPIQQAEGVYCNRTWDGWLCWND

SEQ ID NO: 25678 - protein, 37 aa, Homo sapiens
  ENSP00000386599
MEKKCTLYFLVLLPFFMILVTAELEESPEDSIQLGVT

SEQ ID NO: 25679 - protein, 344 aa, Homo sapiens
  ENSP00000358798
MDKFRMLFQHFQSSSESVMNGICLLLAAVTVKLYSSFDFNCPCLVHYNALYGLGLLLTPPLALFLCGLLANRQSVVMVEEWRRPAGHRRKDPGIIRYMCSSVLQRALAAPLVWILLALLDGKCFVCAFSSSVDPEKFLDFANMTPSQVQLFLAKVPCKEDELVRDSPARKAVSRYLRCLSQAIGWSVTLLLIIAAFLARCLRPCFDQTVFLQRRYWSNYVDLEQKLFDETCCEHARDFAHRCVLHFFASMRSELQARGLRRGNAGRRLELPAVPEPPEGLDSGSGKAHLRAISSREQVDRLLSTWYSSKPPLDLAASPGLCGGGLSHRAPTLALGTRLSQHTDV

SEQ ID NO: 25680 - protein, 219 aa, Homo sapiens
  ENSP00000332498
MPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 25681 - protein, 261 aa, Homo sapiens
  ENSP00000378690
MRLPEQPGEGKPENEKKGDGGALGGGEEPPRSQAPDFPTWEKMPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 25682 - protein, 219 aa, Homo sapiens; identical to SEQ ID NO: 25680
  ENSP00000378691

SEQ ID NO: 25683 - protein, 219 aa, Homo sapiens; identical to SEQ ID NO: 25680
  ENSP00000410704

SEQ ID NO: 25684 - protein, 125 aa, Homo sapiens
  ENSP00000411806
MPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQ

SEQ ID NO: 25685 - protein, 95 aa, Homo sapiens
  ENSP00000384354
QFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 25686 - protein, 417 aa, Homo sapiens
  ENSP00000320866
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 25687 - protein, 247 aa, Homo sapiens
  ENSP00000465105
MLLSVPLLLGLLGLAVAEPAVYFKEQFLDGDGWTSRWIESKHKSDFGKFVLSSGKFYGDEEKDKGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLG

SEQ ID NO: 25688 - protein, 163 aa, Homo sapiens
  ENSP00000465918
  MOD_RES (1)..(1): Any amino acid
XEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRPERSCRRAGRAK

SEQ ID NO: 25689 - protein, 13 aa, Homo sapiens
  ENSP00000466037
  MOD_RES (1)..(1): Any amino acid
XEEDVPGQAKDEL

SEQ ID NO: 25690 - protein, 217 aa, Homo sapiens
  ENSP00000252939
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 25691 - protein, 124 aa, Homo sapiens
  ENSP00000357546
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRGPEF

SEQ ID NO: 25692 - protein, 158 aa, Homo sapiens
  ENSP00000357543
MVKLGCSFSGKPGKDPGDQDGAAMDSVPLISPLDISQLQPPLPDQVVIKTQTEYQLSSPDQQNFPDLEGQRLNCSHPEEGRRVTTPTPPTVGTQDRRRRWKAAGGAWVPSRPVWGPLALREERVAVSHPAQSWPHRLPCTHQAPSRGCRCRLTKQWRS

SEQ ID NO: 25693 - protein, 476 aa, Homo sapiens [sequence omitted]

SEQ ID NO: 25694 - protein, 245 aa, Homo sapiens
  ENSP00000392173
MGRKEEDDCSSWKKQTTNIRKTFIFMEVLGSGAFSEVFLVKQRLTGKLFALKCIKKSPAFRDSSLENEIAVLKKIKHENIVTLEDIYESTTHYYLVMQLVSGGELFDRILERGVYTEKDASLVIQQVLSAVKYLHENGIVHRDLKPENLLYLTPEENSKIMITDFGLSKMEQNGIMSTACGTPGYVGSVDTPHSMKKRSLSFSRRSRRATMSLSLHSGMTFLSQPRTLFATCLRRIRTSGTPVRR

SEQ ID NO: 25695 - protein, 476 aa, Homo sapiens [sequence omitted]

SEQ ID NO: 25696 - protein, 478 aa, Homo sapiens
  ENSP00000261793
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 25697 - protein, 489 aa, Homo sapiens
  ENSP00000381412
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 25698 - protein, 24 aa, Homo sapiens
  ENSP00000427580
MGVVHRDLKPENLLLASKLKGAAV

SEQ ID NO: 25699 - protein, 90 aa, Homo sapiens
  ENSP00000426607
MATITCTRFTEEYQLFEELGKGAFSVVRRCVKVLAGQEYAAKIINTKKLSARDHQKLEREARICRLLKHPNIVRLHDSISEEGHHYLIFD

SEQ ID NO: 25700 - protein, 495 aa, Homo sapiens
  ENSP00000277853
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25701 - protein, 527 aa, Homo sapiens
  ENSP00000315599
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKKRKSSSSVHLMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25702 - protein, 453 aa, Homo sapiens
  ENSP00000393784
RLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25703 - protein, 529 aa, Homo sapiens
  ENSP00000307082
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25704 - protein, 516 aa, Homo sapiens
  ENSP00000361851
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25705 - protein, 335 aa, Homo sapiens
  ENSP00000405561
  MOD_RES (1)..(1): Any amino acid
XYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25706 - protein, 539 aa, Homo sapiens
  ENSP00000378243
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25707 - protein, 556 aa, Homo sapiens
  ENSP00000319060
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25708 - protein, 558 aa, Homo sapiens
  ENSP00000410298
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKGRVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 25709 - protein, 142 aa, Homo sapiens
  ENSP00000426940
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAA

SEQ ID NO: 25710 - protein, 473 aa, Homo sapiens
  ENSP00000422634
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 25711 - protein, 473 aa, Homo sapiens; identical to SEQ ID NO: 25710
  ENSP00000282356

SEQ ID NO: 25712 - protein, 88 aa, Homo sapiens
  ENSP00000423761
MLKVTVPSCSASSCSSVTASAAPGTASLVPDYWIDGSNRDALSDFFEVESELGRGATSIVYRCKQKGTQKPYALKVLKKTDCGKGILQ

SEQ ID NO: 25713 - protein, 88 aa, Homo sapiens; identical to SEQ ID NO: 25712
  ENSP00000424912

SEQ ID NO: 25714 - protein, 109 aa, Homo sapiens
  ENSP00000421606
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIDCGKGILQ

SEQ ID NO: 25715 - protein, 556 aa, Homo sapiens
  ENSP00000376266
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKGTKKKKGLDSMTSTVAAGWLDRRV

SEQ ID NO: 25716 - protein, 545 aa, Homo sapiens
  ENSP00000321230
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 25717 - protein, 498 aa, Homo sapiens
  ENSP00000445944
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKQGSEDNLQGTDPPPVGEEEVLL

SEQ ID NO: 25718 - protein, 541 aa, Homo sapiens
  ENSP00000336634
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKQGSEDNLQGTDPPPVGEEEVLL

SEQ ID NO: 25719 - protein, 588 aa, Homo sapiens
  ENSP00000312741
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 25720 - protein, 343 aa, Homo sapiens
  ENSP00000441352
MQPSCWQTQPRGCCLLPAHIYSLFFSPAIRLLPIPCGCAKVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKGTKKKKGLDSMTSTVAAGWLDRRV

SEQ ID NO: 25721 - protein, 541 aa, Homo sapiens; identical to SEQ ID NO: 25718
  ENSP00000388368

SEQ ID NO: 25722 - protein, 588 aa, Homo sapiens; identical to SEQ ID NO: 25719
  ENSP00000384600

SEQ ID NO: 25723 - protein, 588 aa, Homo sapiens; identical to SEQ ID NO: 25719
  ENSP00000384591

SEQ ID NO: 25724 - protein, 490 aa, Homo sapiens
  ENSP00000388273
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKILVKTMIRKRSFGNPFEGSRREERSLSAPGNLLTKKPTRECESLSELKT

SEQ ID NO: 25725 - protein, 533 aa, Homo sapiens
  ENSP00000376265
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKT

SEQ ID NO: 25726 - protein, 125 aa, Homo sapiens
  ENSP00000444894
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPS

SEQ ID NO: 25727 - protein, 87 aa, Homo sapiens
  ENSP00000445400
MSSCVSSQPSSNRAAPQDELGGRGSSSSESQKPCEALRGLSSLSIHLGMESFIVVTECEPGCAVDLGLARDRPLEADGQEVPLDTSG

SEQ ID NO: 25728 - protein, 473 aa, Homo sapiens
  ENSP00000296471
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 25729 - protein, 470 aa, Homo sapiens
  ENSP00000418809
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 25730 - protein, 434 aa, Homo sapiens
  ENSP00000417614
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKTVVPPQPQMEVPPQPLMAVSPQPPMEASLQPLMGVSPQPLTGALLQPLMGEPHQPQKRALCPPPKAVPCWPPRQLPPLSRLWPSRTAQPQRAPQARLHPLVKGKRLLVMPRSLKGRRPAE

SEQ ID NO: 25731 - protein, 501 aa, Homo sapiens
  ENSP00000419195
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 25732 - protein, 94 aa, Homo sapiens
  ENSP00000420139
MPFGCVTLGDKKNYNQPSEVTDRYDLGQVIKTEEFCEIFRAKDKTTGKLHTCKKFQKRDGRKGEASQHPTAGGCVCDPQGVLYLPGAGHGEGGV

SEQ ID NO: 25733 - protein, 426 aa, Homo sapiens
  ENSP00000420053
MVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 25734 - protein, 427 aa, Homo sapiens
  ENSP00000420724
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 25735 - protein, 143 aa, Homo sapiens
  ENSP00000420766
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATTRSETQATWYGKSWRPWPICTHSRSCTGISSWRTWFTTTG

SEQ ID NO: 25736 - protein, 123 aa, Homo sapiens
  ENSP00000420000
MPFGCVTLGDKKNYNQPSEVFDWILDQGYYSERDTSNVVRQVLEAVAYLHSLKIVHRNLKLENLVYYNRLKNSKIVISDFHLAKLENGLIKEPCGTPDPRGGRPAAVWTPCGLLGHWSHHVHP

SEQ ID NO: 25737 - protein, 473 aa, Homo sapiens; identical to SEQ ID NO: 25728
  ENSP00000484045

SEQ ID NO: 25738 - protein, 477 aa, Homo sapiens
  ENSP00000229922
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 25739 - protein, 365 aa, Homo sapiens
  ENSP00000417705
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHEGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 25740 - protein, 451 aa, Homo sapiens
  ENSP00000368275
MANMQGLVERLERAVSRLESLSAESHRPPGNCGEVNGVIAGVAPSVEAFDKLMDSMVAEFLKNSRILAGDVETHNDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 25741 - protein, 217 aa, Homo sapiens
  ENSP00000417208
MANMQGLVERLERAVSRLESLSAESHRPPGNCGEVNGVIAGVAPSVEAFDKLMDSMVAEFLKNSRILAGDVETHEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 25742 - protein, 194 aa, Homo sapiens
  ENSP00000420615
MANMQGLVERLERAVSRLESLSAESHRPPGNCGEVNGVIAGVAPSVEAFDKLMDSMVAEFLKNSRILAGDVETHNDVAALLKPISEKIQEIQTFRERNRGSNMFNHLSAVSESIPALGWIAVSPKPGPYVKEMNDAATFYTNRVLKDYKHSDLRHVDWVKSYLNIWSELQAYIKEHHTTGLTWSKTNEKRRRQR

SEQ ID NO: 25743 - protein, 413 aa, Homo sapiens
  ENSP00000418604
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVGPVASTVSAFSVLSSGPGLPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 25744 - protein, 104 aa, Homo sapiens
  ENSP00000419906
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHEANKF

SEQ ID NO: 25745 - protein, 394 aa, Homo sapiens
  ENSP00000483435
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVPPPPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 25746 - protein, 394 aa, Homo sapiens
  ENSP00000482279
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNHLSAVSESIPALGWIAVSPKPPPLPPPGPPPLFENEGKKEESSPSRSALFAQLNQGEAITKGLRHVTDDQKTYKNPSLRAQGGQTQSPTKSHTPSPTSPKSYPSQKHAPVLELEGKKWRVEYQEDRNDLVISETELKQVAYIFKCEKSTIQIKGKVNSIIIDNCKKLGLVFDNVVGIVEVINSQDIQIQVMGRVPTISINKTEGCHIYLSEDALDCEIVSAKSSEMNILIPQDGDYREFPIPEQFKTAWDGSKLITEPAEIMA

SEQ ID NO: 25747 - protein, 163 aa, Homo sapiens
  ENSP00000435847
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVV

SEQ ID NO: 25748 - protein, 191 aa, Homo sapiens
  ENSP00000432512
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALL

SEQ ID NO: 25749 - protein, 714 aa, Homo sapiens
  ENSP00000435272
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 25750 - protein, 161 aa, Homo sapiens
  ENSP00000433823
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVD

SEQ ID NO: 25751 - protein, 161 aa, Homo sapiens; identical to SEQ ID NO: 25750
  ENSP00000431528

SEQ ID NO: 25752 - protein, 714 aa, Homo sapiens; identical to SEQ ID NO: 25749
  ENSP00000431686

SEQ ID NO: 25753 - protein, 714 aa, Homo sapiens; identical to SEQ ID NO: 25749
  ENSP00000434176

SEQ ID NO: 25754 - protein, 714 aa, Homo sapiens; identical to SEQ ID NO: 25749
  ENSP00000279247

SEQ ID NO: 25755 - protein, 63 aa, Homo sapiens
  ENSP00000436693
MSEEIITPVYCTGVSAQVQKQRARELGLGRHENAIKYLGQDYEQLRVRCLQSGTLFRDEAFPP

SEQ ID NO: 25756 - protein, 135 aa, Homo sapiens
  ENSP00000431793
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVV

SEQ ID NO: 25757 - protein, 201 aa, Homo sapiens
  ENSP00000436002
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKSPAF

SEQ ID NO: 25758 - protein, 122 aa, Homo sapiens
  ENSP00000435092
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIA

SEQ ID NO: 25759 - protein, 152 aa, Homo sapiens
  ENSP00000431172
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQ

SEQ ID NO: 25760 - protein, 148 aa, Homo sapiens
  ENSP00000435198
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGI

SEQ ID NO: 25761 - protein, 714 aa, Homo sapiens; identical to SEQ ID NO: 25749
  ENSP00000431984

SEQ ID NO: 25762 - protein, 191 aa, Homo sapiens
  ENSP00000433366
MCIPPAPGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRN

SEQ ID NO: 25763 - protein, 815 aa, Homo sapiens
  ENSP00000350181
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 25764 - protein, 729 aa, Homo sapiens
  ENSP00000183936
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 25765 - protein, 821 aa, Homo sapiens
  ENSP00000380349
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 25766 - protein, 309 aa, Homo sapiens
  ENSP00000380384
MHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 25767 - protein, 255 aa, Homo sapiens
  ENSP00000454379
MHGNKQHLQKDFFLYNASKARSKTYINMREVSQRFRLPPSEYVIVPSTYEPHQEGEFILRVFSEKRNLSEEVENTISVDRPVPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNV

SEQ ID NO: 25768 - protein, 188 aa, Homo sapiens
  ENSP00000456607
  MOD_RES (1)..(1): Any amino acid
XGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQFSFVPPQPQPGSSDQESEEQQQFRNIFKQIAGDDMEICADELKKVLNTVVNKHKDLKTHGFTL

SEQ ID NO: 25769 - protein, 156 aa, Homo sapiens
  ENSP00000336840
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 25770 - protein, 156 aa, Homo sapiens; identical to SEQ ID NO: 25769
  ENSP00000455254

SEQ ID NO: 25771 - protein, 191 aa, Homo sapiens
  ENSP00000456575
MEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEAVCRSTCRWHSAPPCARALHHLHAVPPWARNQTSTGFYCCGVN

SEQ ID NO: 25772 - protein, 156 aa, Homo sapiens; identical to SEQ ID NO: 25769
  ENSP00000380387

SEQ ID NO: 25773 - protein, 157 aa, Homo sapiens
  ENSP00000457878
MGGVASTLQGLPMRLGYTGAGGFPGVCLEHLEPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLY

SEQ ID NO: 25774 - protein, 110 aa, Homo sapiens
  ENSP00000457759
KKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDP

SEQ ID NO: 25775 - protein, 169 aa, Homo sapiens
  ENSP00000457898
  MOD_RES (1)..(1): Any amino acid
XSPQPQPGSSDQESEEQQQFRNIFKQIAGDDMEICADELKKVLNTVVNKHKDLKTHGFTLESCRSMIALMDTDGSGKLNLQEFHHLWNKIKAWQMRNAVNDAGFHLNNQLYDIITMRYADKHMNIDFDSFICCFVRLEGMFRAFHAFDKDGDGIIKLNVLEWLQLTMYA

SEQ ID NO: 25776 - protein, 93 aa, Homo sapiens
  ENSP00000456514
KIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 25777 - protein, 67 aa, Homo sapiens
  ENSP00000454937
  MOD_RES (1)..(1): Any amino acid
XFHLNNQLYDIITMRYADKHMNIDFDSFICCFVRLEGMFRAFHAFDKDGDGIIKLNVLEWLQLTMYA

SEQ ID NO: 25778 - protein, 156 aa, Homo sapiens; identical to SEQ ID NO: 25769
  ENSP00000348667

SEQ ID NO: 25779 - protein, 773 aa, Homo sapiens
  ENSP00000326281
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 25780 - protein, 52 aa, Homo sapiens
  ENSP00000467244
MFSCVKPYEDQNYSALRRDCRRRKVLFEDPLFPATDDSLYYKGTPGPAVRCT

SEQ ID NO: 25781 - protein, 640 aa, Homo sapiens
  ENSP00000278559
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 25782 - protein, 97 aa, Homo sapiens
  ENSP00000435894
MFSCVKPYEDQNYSALRRDCRRRKVLFEDPLFPATDDSLYYKGTPGPAVRWKRPKGICEDPRLFVDGISSHDLHQGQVGNCWFVAACSSLASRESLW

SEQ ID NO: 25783 - protein, 640 aa, Homo sapiens; identical to SEQ ID NO: 25781
  ENSP00000432332

SEQ ID NO: 25784 - protein, 680 aa, Homo sapiens
  ENSP00000409996
MFSCVKPYEDQNYSALRRDCRRRKVLFEDPLFPATDDSLYYKGTPGPAVRWKRPKYSGHSLAPHRPGWGDARRMENVPRPGSSGCPSSSLRARDLGICEDPRLFVDGISSHDLHQGQVGNCWFVAACSSLASRESLWQKVIPDWKEQEWDPEKPNAYAGIFHFHFWRFGEWVDVVIDDRLPTVNNQLIYCHSNSRNEFWCALVEKAYAKLAGCYQALDGGNTADALVDFTGGVSEPIDLTEGDFANDETKRNQLFERMLKVHSRGGLISASIKAVTAADMEARLACGLVKGHAYAVTDVRKVRLGHGLLAFFKSEKLDMIRLRNPWGEREWNGPWSDTSEEWQKVSKSEREKMGVTVQDDGEFWMTFEDVCRYFTDIIKCRVINTSHLSIHKTWEEARLHGAWTLHEDPRQNRGGGCINHKDTFFQNPQYIFEVKKPEDEVLICIQQRPKRSTRREGKGENLAIGFDIYKVEENRQYRMHSLQHKAASSIYINSRSVFLRTDQPEGRYVIIPTTFEPGHTGEFLLRVFTDVPSNCRELRLDEPPHTCWSSLCGYPQLVTQVHVLGAAGLKDSPTGANSYVIIKCEGDKVRSAVQKGTSTPEYNVKGIFYRKKLSQPITVQVWNHRVLKDEFLGQVHLKADPDNLQALHTLHLRDRNSRQPSNLPGTVAVHILSSTSLMAV

SEQ ID NO: 25785 - protein, 690 aa, Homo sapiens
  ENSP00000271971
MPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDSSPEWRSVGPAEQKRLCHTALDDGEFWMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 25786 - protein, 664 aa, Homo sapiens
  ENSP00000346538
MPYLYRAPGPQAHPVPKDARITHSSGQSFEQMRQECLQRGTLFEDADFPASNSSLFYSERPQIPFVWKRPGEIVKNPEFILGGATRTDICQGELGDCWLLAAIASLTLNQKALARVIPQDQSFGPGYAGIFHFQFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDRMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 25787 - protein, 627 aa, Homo sapiens
  ENSP00000355626
MPYLYRAPGPQAHPVPKDARITHSSGQSFEQMRQECLQRGTLFEDADFPASNSSLFYSERPQIPFVWKRPGFWQHSEWLDVVIDDRLPTFRDRLVFLHSADHNEFWSALLEKAYAKLNGSYEALKGGSAIEAMEDFTGGVAETFQTKEAPENFYEILEKALKRGSLLGCFIDTRSAAESEARTPFGLIKGHAYSVTGIDQVSFRGQRIELIRIRNPWGQVEWNGSWSDSSPEWRSVGPAEQKRLCHTALDDGEFWMAFKDFKAHFDKVEICNLTPDALEEDAIHKWEVTVHQGSWVRGSTAGGCRNFLDTFWTNPQIKLSLTEKDEGQEECSFLVALMQKDRRKLKRFGANVLTIGYAIYECPDKDEHLNKDFFRYHASRARSKTFINLREVSDRFKLPPGEYILIPSTFEPHQEADFCLRIFSEKKAITRDMDGNVDIDLPEPPKPTPPDQETEEEQRFRALFEQVAGEDMEVTAEELEYVLNAVLQKKKDIKFKKLSLISCKNIISLMDTSGNGKLEFDEFKVFWDKLKQWINLFLRFDADKSGTMSTYELRTALKAAGFQLSSHLLQLIVLRYADEELQLDFDDFLNCLVRLENASRVFQALSTKNKEFIHLNINEFIHLTMNI

SEQ ID NO: 25788 - protein, 260 aa, Homo sapiens
  ENSP00000264203
MPRQFQDTGFSRPGLGQPRRCDPEPRKSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEVCADFCRQIKTRSSEE

SEQ ID NO: 25789 - protein, 260 aa, Homo sapiens
  ENSP00000364286
MRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 25790 - protein, 277 aa, Homo sapiens
  ENSP00000364284
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 25791 - protein, 301 aa, Homo sapiens
  ENSP00000401010
MHPSRRSLPFPLNCQLARVGTADYGSPSDQSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 25792 - protein, 272 aa, Homo sapiens
  ENSP00000264202
MSDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSVQTFADKSKQEALKNDLVEALKRKQQC

SEQ ID NO: 25793 - protein, 354 aa, Homo sapiens
  ENSP00000178638
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 25794 - protein, 343 aa, Homo sapiens
  ENSP00000343088
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 25795 - protein, 283 aa, Homo sapiens
  ENSP00000403028
MPRRSLHAAAVLLLVILKEQPSSPAPVNGSKWTYFVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 25796 - protein, 337 aa, Homo sapiens
  ENSP00000358107
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 25797 - protein, 42 aa, Homo sapiens
  ENSP00000475869
MLFSALLLEVIWILAADGGQHWTYEAPPFWISSCLEFHIYGS

SEQ ID NO: 25798 - protein, 130 aa, Homo sapiens
  ENSP00000475238
QKTSVPPFNLRELLPKQLGQYFRYNGSLTTPPCYQSVLWTVFYRRSQISMEQLEKLQGTLFSTEEEPSKLLVQNYRALQPLNQRMVFASFIQGSSYTTGRRGWKTERVWSSPQHKPRLRHKFLLRYHGCG

SEQ ID NO: 25799 - protein, 260 aa, Homo sapiens
  ENSP00000285379
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 25800 - protein, 97 aa, Homo sapiens
  ENSP00000428443
MSHHWGYGKHNGPEHWHKDFPIAKGERQSPVDIDTHTAKYDPSLKPLSVSYDQATSLRILNNGHAFNVEFDDSQDKAASLGSLEHQIWGFWESCAAT

SEQ ID NO: 25801 - protein, 101 aa, Homo sapiens
  ENSP00000428947
MSHHWGYGKHNGPEHWHKDFPIAKGERQSPVDIDTHTAKYDPSLKPLSVSYDQATSLRILNNGHAFNVEFDDSQDKAEKGISMLRKKDVKNIHSPDNACEE

SEQ ID NO: 25802 - protein, 312 aa, Homo sapiens
  ENSP00000300900
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 25803 - protein, 38 aa, Homo sapiens
  ENSP00000466964
MMLLENKASISGGGLPAPYQAKQLHLHWSDLPYKGSEH

SEQ ID NO: 25804 - protein, 106 aa, Homo sapiens
  ENSP00000467465
MRMLLALLALSAARPSASAESHWCYEVQAESSNYPCLVPVKWGGNCQKDRQSPINIVTTKAKVDKKLGRFFFSGYDKKQTWTVQNNGHSGWNPGERGLPATGGGTV

SEQ ID NO: 25805 - protein, 184 aa, Homo sapiens
  ENSP00000465837
VKEAQDPEDEIAVLAFLVEIGRMNWPPPLAPCRLSQDPSLPFQAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 25806 - protein, 99 aa, Homo sapiens
  ENSP00000464757
  MOD_RES (1)..(1): Any amino acid
XSNIPKPEMSTTMAESSLLDLLPKEEKLRHYFRYLGSLTTPTCDEKVVWTVFREPIQLHREQVHRAWGRAWAPTAWLPRNYPSVCPQRSLRIQVGSPGN

SEQ ID NO: 25807 - protein, 290 aa, Homo sapiens
  ENSP00000314407
MADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 25808 - protein, 196 aa, Homo sapiens
  ENSP00000489403
MIVETEKCSISMKMASPEDVSEVLAHIGTCLRKIFPGLSPVRIMKKVSMEPSERLASLQALWDSQTVAEQGPCGGFSQMYACVCDWLGFSYREEVQWDVDTIYLTQDTRELNLQDFSHLDHRKSRIAVWSLKSSSQLNRPGKKYTSWIYLLFAQPGTTEDGEAGSAVSVVVADGPKASSSQAIFFFSCLEQFSFFL

SEQ ID NO: 25809 - protein, 1371 aa, Homo sapiens
  ENSP00000331983
MTEESSDVPRELIESIKDVIGRKIKISVKKKVKLEVKGDKVENKVLVLTSCRAFLVTARIPTKLELTFSYLEIHGVVCSKSAQMIVETEKCSISMKMASPEDVSEVLAHIGTCLRKIFPGLSPVRIMKKVSMEPSERLASLQALWDSQTVAEQGPCGGFSQMYACVCDWLGFSYREEVQWDVDTIYLTQDTRELNLQDFSHLDHRDLIPIIAALEYNQWFTKLSSKDLKLSTDVCEQILRVVSRSNRLEELVLENAGLRTDFAQKLASALAHNPNSGLHTINLAGNPLEDRGVSSLSIQFAKLPKGLKHLNLSKTSLSPKGVNSLSQSLSANPLTASTLVHLDLSGNVLRGDDLSHMYNFLAQPNAIVHLDLSNTECSLDMVCGALLRGCLQYLAVLNLSRTVFSHRKGKEVPPSFKQFFSSSLALMHINLSGTKLSPEPLKALLLGLACNHNLKGVSLDLSNCELRSGGAQVLEGCIAEIHNITSLDISDNGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQEKRAACAQKKLGNDAVSQDSSSPALSGVERSDGGGAVPKLHPGLPENRFGLGTPEKNTKAEPKAEAGSRSRSSSSTPTSPKPLLQSPKPSLAARPVIPQKPRTASRPDDIPDSPSSPKVALLPPVLKKVPSDKERDGQSSPQPSPRTFSQEVSRRSWGQQAQEYQEQKQRSSSKDGHQGSKSNDSGEEAEKEFIFV

SEQ ID NO: 25810 - protein, 932 aa, Homo sapiens
  ENSP00000489114
EVPPSFKQFFSSSLALMHINLSGTKLSPEPLKALLLGLACNHNLKGVSLDLSNCELGHCLRSGGAQVLEGCIAEIHNITSLDISDNGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMTLCCTSMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQEKRAACAQKKLGNDAVSQDSSSPALSGVERSDGGGAVPKLHPGLPENRFGLGTPEKNTKAEPKAEAGSRSRSSSSTPTSPKPLLQSPKPSLAARPVIPQKPRTASRPDDIPDSPSSPKVALLPPVLKKVPSDKERDGQSSPQPSPRTFSQEACPTNF

SEQ ID NO: 25811 - protein, 924 aa, Homo sapiens
  ENSP00000431670
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 25812 - protein, 827 aa, Homo sapiens
  ENSP00000308268
MLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 25813 - protein, 950 aa, Homo sapiens
  ENSP00000389009
MLSLDPSGPEWDCPLGSKDLEEEGPWGGGSGLPPTGCFPGSWRQDVGLDCKGSPEGAEARAWTVYYYSLLQSCLQQAGLPETQDRGQVPRTGCPGAEVTLCVLGSPSTFLPVLLEGGVQSPGNMLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 25814 - protein, 340 aa, Homo sapiens
  ENSP00000482745
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 25815 - protein, 168 aa, Homo sapiens
  ENSP00000421408
MADEKPSNGVLVHMVKLLIKTFLDGIFDDLMENNVLNTDEIHLIGKCLKFVVSNAENLVDDITETAQIAGKIFREHLWNSKKQLSSAFLEIQGAQPSGKLKLCPHAHFHELKTKRADEIYPVMEKERRTCLASTSATKNSTIFIIEMVLNLTFWGCEIYLKTLDTQWL

SEQ ID NO: 25816 - protein, 340 aa, Homo sapiens; identical to SEQ ID NO: 25814
  ENSP00000424038

SEQ ID NO: 25817 - protein, 139 aa, Homo sapiens
  ENSP00000426427
MADISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHIMFLGDMKQMALSSFPKLSTTSESILGVII

SEQ ID NO: 25818 - protein, 276 aa, Homo sapiens
  ENSP00000425652
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPRSTFI

SEQ ID NO: 25819 - protein, 294 aa, Homo sapiens
  ENSP00000423970
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKMVLGLFGSPLTVEKPVQILMVGSCKVTSVMMLLQRLMWKRTSLLSNLPHHVQHSFETPNILTQLPTIERLSMTRYFYLFPGN

SEQ ID NO: 25820 - protein, 141 aa, Homo sapiens
  ENSP00000427437
MADISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHVQHSFETPNILTQLPTIERLSMTRYFYLFPGN

SEQ ID NO: 25821 - protein, 223 aa, Homo sapiens
  ENSP00000423899
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHIMFLGDMKQMALSSFPKLSTTSESILGVII

SEQ ID NO: 25822 - protein, 168 aa, Homo sapiens; identical to SEQ ID NO: 25815
  ENSP00000424963

SEQ ID NO: 25823 - protein, 225 aa, Homo sapiens
  ENSP00000421815
MADEKPSNGVLVHMVKLLIKTFLDGIFDDLMENNVLNTDEIHLIGKCLKFVVSNAENLVDDITETAQIAGKIFREHLWNSKKQLSSDISSDGEREANMPGLNIRNKEFNYLHNRNGSELDLLGMDLLENLGYSVVIKENLTAQMVLGLFGSPLTVEKPVQILMVGSCKVTSVMMLLQRLMWKRTSLLSNLPHHVQHSFETPNILTQLPTIERLSMTRYFYLFPGN

SEQ ID NO: 25824 - protein, 256 aa, Homo sapiens
  ENSP00000426566
MADISSDGEREANMPGLNIRNKEFNYLHNRNGSELDLLGMDLLENLGYSVVIKENLTAQEMETALRQFAAHPEHQSSDSTFLVFMSHSILNGICGTKHWDQEPDVLHDDTIFEIFNNRNCQSLKDKPKVIIMQACRGNGAGIVWFTTDSGKASADTHGRLLQGNICNDAVTKAHVEKDFIAFKSSTPHNVSWRHETNGSVFISQIIYYFREYSWSHHLEEIFQKVQHSFETPNILTQLPTIERLSMTRYFYLFPGN

SEQ ID NO: 25825 - protein, 340 aa, Homo sapiens; identical to SEQ ID NO: 25814
  ENSP00000427128

SEQ ID NO: 25826 - protein, 182 aa, Homo sapiens
  ENSP00000377210
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQVIILGEIQRMAPGSSSRFVPC

SEQ ID NO: 25827 - protein, 277 aa, Homo sapiens
  ENSP00000311032
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 25828 - protein, 277 aa, Homo sapiens; identical to SEQ ID NO: 25827
  ENSP00000428929

SEQ ID NO: 25829 - protein, 182 aa, Homo sapiens; identical to SEQ ID NO: 25826
  ENSP00000428372

SEQ ID NO: 25830 - protein, 182 aa, Homo sapiens; identical to SEQ ID NO: 25826
  ENSP00000377213

SEQ ID NO: 25831 - protein, 117 aa, Homo sapiens
  ENSP00000407142
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCV

SEQ ID NO: 25832 - protein, 377 aa, Homo sapiens
  ENSP00000388566
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 25833 - protein, 321 aa, Homo sapiens
  ENSP00000376857
MADSMQEKQRMAGQMLLQTFFNIDQISPNKKAHPNMEAGPPESGESTDALKLCPHEEFLRLCKERAEEIYPIKERNNRTRLALIICNTEFDHLPPRNGADFDITGMKELLEGLDYSVDVEENLTARDMESALRAFATRPEHKSSDSTFLVLMSHGILEGICGTVHDEKKPDVLLYDTIFQIFNNRNCLSLKDKPKVIIVQACRGANRGELWVRDSPASLEVASSQSSENLEEDAVYKTHVEKDFIAFCSSTPHNVSWRDSTMGSIFITQLITCFQKYSWCCHLEEVFRKVQQSFETPRAKAQMPTIERLSMTRYFYLFPGN

SEQ ID NO: 25834 - protein, 72 aa, Homo sapiens
  ENSP00000432879
  MOD_RES (1)..(1): Any amino acid
XNVSWRDSTMGSIFITQLITCFQKYSWCCHLEEVFRKEATSSPALLNQLQGAPSLVQLAYLTFCISIKVKTN

SEQ ID NO: 25835 - protein, 147 aa, Homo sapiens
  ENSP00000401673
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFLRLCKERAEEIYPIKERNNRTRLALIICNTEFD

SEQ ID NO: 25836 - protein, 421 aa, Homo sapiens
  ENSP00000449584
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVSAAFLCKGEGRLLRGSVSSWGWGFGVSRAGPNQG

SEQ ID NO: 25837 - protein, 416 aa, Homo sapiens
  ENSP00000330237
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 25838 - protein, 266 aa, Homo sapiens
  ENSP00000255256
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 25839 - protein, 152 aa, Homo sapiens
  ENSP00000383588
  MOD_RES (1)..(1): Any amino acid
XADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLTVL

SEQ ID NO: 25840 - protein, 198 aa, Homo sapiens
  ENSP00000408691
  MOD_RES (1)..(1): Any amino acid
XCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGGFVSWRDPKSGSWYVETLDDIFEQWAHSEDLQSLLLRVANAVSVKGIYKQMPGCFNFLRKKLFFKTS

SEQ ID NO: 25841 - protein, 333 aa, Homo sapiens
  ENSP00000365051
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 25842 - protein, 95 aa, Homo sapiens
  ENSP00000449216
MDEADRRLLRRCRLRLVEELQVDQLWDALLSRELFRPHMIEDIQRAGSGSRRDQARQLIIDLETRGSQALPLFISCLEDTGQDMLASFLRTNRCS

SEQ ID NO: 25843 - protein, 266 aa, Homo sapiens
  ENSP00000396540
MLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFP

SEQ ID NO: 25844 - protein, 254 aa, Homo sapiens
  ENSP00000411304
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKASHLQFPGAVYGTDGCPVSVEKIVNIFNGTSCPSLGGKPKLFFI

SEQ ID NO: 25845 - protein, 47 aa, Homo sapiens
  ENSP00000480785
MLASFLRTNRQAAKLSKPTLENLTPVVLRPEIRKPEVLRPETPRPVD

SEQ ID NO: 25846 - protein, 399 aa, Homo sapiens
  ENSP00000261448
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 25847 - protein, 1119 aa, Homo sapiens
  ENSP00000387057
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 25848 - protein, 1159 aa, Homo sapiens
  ENSP00000386962
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 25849 - protein, 292 aa, Homo sapiens
  ENSP00000311314
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVEAPIPHSMRETAAVAVGFVSWPASASRSCALCISIAMALST

SEQ ID NO: 25850 - protein, 159 aa, Homo sapiens
  ENSP00000468028
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKTESCAVAQTGVQWRDLGSLQPPPPVFKRCSCLGLPSSWNYSPLRTWCAWAT

SEQ ID NO: 25851 - protein, 136 aa, Homo sapiens
  ENSP00000467947
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKSPVNFYRWKIEQLQIQMEAAPFRSKGSR

SEQ ID NO: 25852 - protein, 660 aa, Homo sapiens
  ENSP00000386950
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERY

SEQ ID NO: 25853 - protein, 165 aa, Homo sapiens
  ENSP00000395093
RWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVEAVGFVSWPASASRSCALCISIAMALST

SEQ ID NO: 25854 - protein, 180 aa, Homo sapiens
  ENSP00000470225
  MOD_RES (1)..(1): Any amino acid
XRNRGSGSWIRVLASECIKKLCPVYFHSNGSEYIMALTTGKHEGYVHFGTIRASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQ

SEQ ID NO: 25855 - protein, 178 aa, Homo sapiens
  ENSP00000339191
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 25856 - protein, 167 aa, Homo sapiens
  ENSP00000377113
MSGGKYVDSEGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 25857 - protein, 86 aa, Homo sapiens
  ENSP00000409541
MSGGKYVDSEVGIRGGAPARACGECPLLLSASPNIPTAALAPALSPLRSTPLALAPLRNGPGRGGEEKPGMFYVFLMERGPREPLS

SEQ ID NO: 25858 - protein, 147 aa, Homo sapiens
  ENSP00000384348
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 25859 - protein, 138 aa, Homo sapiens
  ENSP00000389033
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSN

SEQ ID NO: 25860 - protein, 147 aa, Homo sapiens; identical to SEQ ID NO: 25858
  ENSP00000377111

SEQ ID NO: 25861 - protein, 147 aa, Homo sapiens; identical to SEQ ID NO: 25858
  ENSP00000377110

SEQ ID NO: 25862 - protein, 147 aa, Homo sapiens; identical to SEQ ID NO: 25858
  ENSP00000479447

SEQ ID NO: 25863 - protein, 162 aa, Homo sapiens
  ENSP00000222693
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 25864 - protein, 112 aa, Homo sapiens
  ENSP00000345679
MGLETEKADVQLFMDDDSYSHHSGLEYADPEKFADSDQDRDPHRLNSHLKDFNAFCKDLPNGSAFSADNMEECDRCYHCSIVYERRTMLLFCQPATEPGLNTWTPGLEIGIL

SEQ ID NO: 25865 - protein, 113 aa, Homo sapiens
  ENSP00000377120
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIW

SEQ ID NO: 25866 - protein, 567 aa, Homo sapiens
  ENSP00000332122
MPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 25867 - protein, 653 aa, Homo sapiens
  ENSP00000268679
MPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLDVPREFLPRTLTGYVPEDIWRKAEEAVNEVKRQAMSELQKAVSDAERKAHELITTERAKMERALAEAKRQASEDALTVINQQEDSSESCWNCGRKASETCSGCNAARYCGSFCQHRDWEKHHHVCGQSLQGPTAVVADPVPGPPEAAHSLGPSLPVGAASPSEAGSAGPSRPGSPSPPGPLDTVPR

SEQ ID NO: 25868 - protein, 34 aa, Homo sapiens
  ENSP00000464125
  MOD_RES (1)..(1): Any amino acid
XGPEGPQLGKHGLVCQEAWSSERLVGQRLGAGRP

SEQ ID NO: 25869 - protein, 418 aa, Homo sapiens
  ENSP00000454851
MPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISPEIGERVRTLVLGLVNSTLTIEEFHSKLQEATNFPLRPFVIPFLKANLPLLQRELLHCARLAKQTPAQYLAQHEQLLLDASASSPIDSSELLLEVNENGKRRTPDRTKENGSDRDPLHPEHLSKRPCTLNPAQRYSPSNGPPQPTPPPHYRLEDIAMAHHFRDAYRHPDPRELRERHRPLVVPGSRQEEVIDHKLTEREWAEEWKHLNNLLNCIMDMVEKTRRSLTVLRRCQEADREELNHWARRYSDAEDTKKGPAPAAARPRSSSAGPEGPQLGKHGLVCQEAWS

SEQ ID NO: 25870 - protein, 121 aa, Homo sapiens
  ENSP00000457410
MPDSPAEVKTQPRSTPPSMPPPPPAASQGATRPPSFTPHTLMNGSSHSPTAINGAPCTPNGFSNGPATSSTASLSTQHLPPACGARQLSKLKRFLTTLQQFGSDISPEIGERVRTLVLGLV

SEQ ID NO: 25871 - protein, 132 aa, Homo sapiens
  ENSP00000456717
MPDSPAEVKTQPRSTPPSMPPPPPAASQGATRPPSFTPHTHREDGPATLPHGRFHGCLKWSMVCLLMNGSSHSPTAINGAPCTPNGFSNGPATSSTASLSTQHLPPACGARQLSKLKRFLTTLQQFGSDISP

SEQ ID NO: 25872 - protein, 130 aa, Homo sapiens
  ENSP00000454872
MPASRLRDRAASSASGSTCGSMSQTHPVLESGLLASAGCSAPRGPRKGGPAPVDRKAKASAMPDSPAEVKTQPRSTPPSMPPPPPAASQGATRPPSFTPHTLMNGSSHSPTAINGAPCTPNGFSNGPATS

SEQ ID NO: 25873 - protein, 62 aa, Homo sapiens
  ENSP00000454609
MPDSPAEVKTQPRSTPPSMPPPPPAASQGATRPPSFTPHTHREDGPATLPHGRFHGCLKWSM

SEQ ID NO: 25874 - protein, 22 aa, Homo sapiens
  ENSP00000456102
MPDSPAEVKTQPRSTPPSMPPP

SEQ ID NO: 25875 - protein, 82 aa, Homo sapiens
  ENSP00000462273
MILNGVCVIWKGWIDLQRLDGMGCLEFDEERAQQEDALAQQAFEEARRRTREFEDRDRSHREEMEVRVSQLLAVTGKKTTRP

SEQ ID NO: 25876 - protein, 182 aa, Homo sapiens
  ENSP00000290858
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEVRVSQLLAVTGKKTTRP

SEQ ID NO: 25877 - protein, 93 aa, Homo sapiens
  ENSP00000456637
MPRVVPDQRSKFENEEFFRKLSRECEIKYTGFRDRPHEERQARFQNACRDGRSEIVYLKAPMILNGVCVIWKGWIDLQRLDGMGCLEFDEERA

SEQ ID NO: 25878 - protein, 187 aa, Homo sapiens
  ENSP00000415151
MPRVVPDQRSKFENEEFFRKLSRECEIKYTGFRDRPHEERQARFQNACRDGRSEIAFVATGTNLSLQFFPASWQGEQRQTPSREYVDLEREAGKVYLKAPMILNGVCVIWKGWIDLQRLDGMGCLEFDEERAQQEDALAQQAFEEARRRTREFEDRDRSHREEMEARRQQDPSPGSNLGGGDDLKLR

SEQ ID NO: 25879 - protein, 60 aa, Homo sapiens
  ENSP00000462932
  MOD_RES (1)..(1): Any amino acid
XRKLSRECEIKYTGFRDRPHEERQARFQNACRDGRSEIARRQQDPSPGSNLGGGDDLKLR

SEQ ID NO: 25880 - protein, 61 aa, Homo sapiens
  ENSP00000462148
MILNGVCVIWKGWIDLQRLDGMGCLEFDEERAQQEDALAQQAFEEARRRTREFEDRDRSHR

SEQ ID NO: 25881 - protein, 321 aa, Homo sapiens
  ENSP00000377598
GITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 25882 - protein, 982 aa, Homo sapiens [sequence omitted]

SEQ ID NO: 25883 - protein, 197 aa, Homo sapiens
  ENSP00000384170
MLNGTHGPSSEKKSNIPDLSIYLKGEDAFDALPPSLPPPPPPARHSLIEHSKPPGSSSRPSSGQDLFLLPSDPFVDLASGQVPLPPARRLPGENVKTNRTSQDYDQLPSCSDGSQAPARPPKPRPRRTAPEIHHRKPHGPEAALENVDAKIAKLMGEGYAFEEVKRALEIAQNNVEVARSILREFAFPPPVSPRLNL

SEQ ID NO: 25884 - protein, 770 aa, Homo sapiens
  ENSP00000384816
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGTYRI

SEQ ID NO: 25885 - protein, 810 aa, Homo sapiens
  ENSP00000384938
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQDRRNLTKLSLIFSHMLAEIKAIFPNGQFQGDNFRITKADAAEFWRKFFGDKTIVPWKVFRQCLHEVHQISSGLEAMALKSTIDLTCNDYISVFEFDIFTRLFQPWGSILRNWNFLAVTHPGYMAFLTYDEVKARLQKYSTKPGSYIFRLSCTRLGQWAIGYVTGDGNILQTIPHNKPLFQALIDGSREGFYLYPDGRSYNPDLTGLCEPTPHDHIKVTQEQYELYCEMGSTFQLCKICAENDKDVKIEPCGHLMCTSCLTAWQESDGQGCPFCRCEIKGTEPIIVDPFDPRDEGSRCCSIIDPFGMPMLDLDDDDDREESLMMNRLANVRKCTDRQNSPVTSPGSSPLAQRRKPQPDPLQIPHLSLPPVPPRLDLIQKGIVRSPCGSPTGSPKSSPCMVRKQDKPLPAPPPPLRDPPPPPPERPPPIPPDNRLSRHIHHVESVPSRDPPMPLEAWCPRDVFGTNQLVGCRLLGEGSPKPGITASSNVNGRHSRVGSDPVLMRKHRRHDLPLEGAKVFSNGHLGSEEYDVPPRLSPPPPVTTLLPSIKCTGPLANSLSEKTRDPVEEDDDEYKIPSSHPVSLNSQPSHCHNVKPPVRSCDNGHCMLNGTHGPSSEKKSNIPDLSIYLKGDVFDSASDPVPLPPARPPTRDNPKHGSSLNRTPSDYDLLIPPLG

SEQ ID NO: 25886 - protein, 161 aa, Homo sapiens
  ENSP00000409750
MALAPGPDAHAHLPPLIELKFQMANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQD

SEQ ID NO: 25887 - protein, 139 aa, Homo sapiens
  ENSP00000400949
MANSMNGRNPGGRGGNPRKGRILGIIDAIQDAVGPPKQAAADRRTVEKTWKLMDKVVRLCQNPKLQLKNSPPYILDILPDTYQHLRLILSKYDDNQKLAQLSENEYFKIYIDSLMKKSKRAIRLFKEGKERMYEEQSQD

SEQ ID NO: 25888 - protein, 139 aa, Homo sapiens; identical to SEQ ID NO: 25887
  ENSP00000393906

SEQ ID NO: 25889 - protein, 193 aa, Homo sapiens
  ENSP00000219197
MLGVLELLLLGAAWLAGPARGQNETEPIVLEGKCLVVCDSNPTSDPTGTALGISVRSGSAKVAFSAIRSTNHEPSEMSNRTMIIYFDQVLVNIGNNFDSERSTFIAPRKGIYSFNFHVVKVYNRQTIQVSLMLNGWPVISAFAGDQDVTREAASNGVLIQMEKGDRAYLKLERGNLMGGWKYSTFSGFLVFPL

SEQ ID NO: 25890 - protein, 140 aa, Homo sapiens
  ENSP00000455718
MLGVLELLLLGAAWLAGPARGQNETEPIVLEGKCLVVCDSNPTSDPTGTALGISVRSGSAKVAFSAIRSTNHEPSEMSNRTMIIYFDQVSVPSSRGVQIGLVKEGWMEDRCPVLSKGSAEARGRQSGTDSCPLPFVPVSL

SEQ ID NO: 25891 - protein, 193 aa, Homo sapiens; identical to SEQ ID NO: 25889
  ENSP00000444651

SEQ ID NO: 25892 - protein, 224 aa, Homo sapiens
  ENSP00000463771
MQAPGRGPLGLRLMMPGRRGALREPGGCGSCLGVALALLLLLLPACCPVRAQNDTEPIVLEGKCLVVCDSSPSADGAVTSSLGISVRSGSAKVAFSATRSTNHEPSEMSNRTMTIYFDQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 25893 - protein, 224 aa, Homo sapiens; identical to SEQ ID NO: 25892
  ENSP00000269503

SEQ ID NO: 25894 - protein, 108 aa, Homo sapiens
  ENSP00000464490
MFQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 25895 - protein, 110 aa, Homo sapiens
  ENSP00000462632
MDWDKVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 25896 - protein, 205 aa, Homo sapiens
  ENSP00000267406
MLGAKPHWLPGPLHSPGLPLVLVLLALGAGWAQEGSEPVLLEGECLVVCEPGRAAAGGPGGAALGEAPPGRVAFAAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 25897 - protein, 154 aa, Homo sapiens
  ENSP00000450935
MWGLSGQSFGRTLTPTLKMRSTWGCCSRTLFSASADTAKRSGDAGRAPQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 25898 - protein, 551 aa, Homo sapiens
  ENSP00000381225
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 25899 - protein, 551 aa, Homo sapiens; identical to SEQ ID NO: 25898
  ENSP00000381231

SEQ ID NO: 25900 - protein, 551 aa, Homo sapiens; identical to SEQ ID NO: 25898
  ENSP00000352643

SEQ ID NO: 25901 - protein, 551 aa, Homo sapiens; identical to SEQ ID NO: 25898
  ENSP00000344460

SEQ ID NO: 25902 - protein, 149 aa, Homo sapiens
  ENSP00000402823
  MOD_RES (1)..(1): Any amino acid
XGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPADHSTGKSSQRQMVFGVVTAIDLLNFVAAQERDQK

SEQ ID NO: 25903 - protein, 159 aa, Homo sapiens
  ENSP00000408014
  MOD_RES (1)..(1): Any amino acid
XVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPAEKKKDANSNVRVPKSSLPGACPRLSPPSVAAFKHVRAACS

SEQ ID NO: 25904 - protein, 224 aa, Homo sapiens
  ENSP00000405929
  MOD_RES (1)..(1): Any amino acid
XGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQSQDQAWAGVVGGPAGSPNQVFLEHVHACHHRLWLLSSTSGLRAHNRDGTAPKT

SEQ ID NO: 25905 - protein, 177 aa, Homo sapiens
  ENSP00000388235
MPSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEK

SEQ ID NO: 25906 - protein, 137 aa, Homo sapiens
  ENSP00000484049
  MOD_RES (1)..(1): Any amino acid
XTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKVKYH

SEQ ID NO: 25907 - protein, 160 aa, Homo sapiens
  ENSP00000484231
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGIITIVDSKYGLKVKYH

SEQ ID NO: 25908 - protein, 180 aa, Homo sapiens
  ENSP00000480837
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKVKYH

SEQ ID NO: 25909 - protein, 46 aa, Homo sapiens
  ENSP00000480830
  MOD_RES (1)..(1): Any amino acid
XTGLADPGAVASMFWVDAELGSDIYLDGIITIVDSKYGLKAKNWTT

SEQ ID NO: 25910 - protein, 73 aa, Homo sapiens
  ENSP00000478412
CSVKDNGLRAIENLMQKKGKFDDILLETTGLADPGAVASMFWVDAELGSDIYLDGIITIVDSKYGLKAKNWTT

SEQ ID NO: 25911 - protein, 359 aa, Homo sapiens
  ENSP00000482804
MYFKRAPRAFPVLLTGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 25912 - protein, 180 aa, Homo sapiens; identical to SEQ ID NO: 25908
  ENSP00000481300

SEQ ID NO: 25913 - protein, 395 aa, Homo sapiens
  ENSP00000366608
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSRVDLSNVLDLHAFDSLSGISLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 25914 - protein, 376 aa, Homo sapiens
  ENSP00000401079
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTLRSINGLGQILETQRSSLQKKLQHVPGTQPHLDQSIVTITFDVPGNAKEEHLNMFIQNLLWEKNVRNKDNHCMEVIRLKGLVSIKDKSQQVIVQGVHELCDLEETPVSWKDDTERTNRLVLIGRNLDKDILKQLFIATVTETEKQWTTHFKEDQVCT

SEQ ID NO: 25915 - protein, 406 aa, Homo sapiens
  ENSP00000404464
MVPPPPSRGGAARGQLGRSLGPLLLLLALGHTWTYREEPEDGDREICSESKIATTKYPCLKSSGELTTCYRKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 25916 - protein, 46 aa, Homo sapiens
  ENSP00000467710
MVKAGTCCATCKEFYQMKQTVLQLKQKIALLPNNAADLGKYITGDK

SEQ ID NO: 25917 - protein, 336 aa, Homo sapiens
  ENSP00000381241
RKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 25918 - protein, 715 aa, Homo sapiens
  ENSP00000309836
MAADESSQNTLRLQFKAMQEMQHKRLQKQMEKKREKELSLKSRADDQEEPLEVSDGLSLLHAGEPNSKNSFEKRVLEDEIEHLRNELRETVDENGRLYKLLKERDFEIKHLKKKIEEDRFAFTGTAGVAGDVVATKIVELSKKNRLLMAESEGAKTRVKQLTNRIQELERELQTALTRLSAKGATDAGAKPPRAQMGDRALLETPEVKALQDRLVATNLKMSDLRNQIQSVKQELRMAQKVLAREVGEDINVQQLLSSPGTWRGRAQQILVLQSKVQELEKQLGQARSQSAGTASDELSVYPDPRKLSAQEKNLLRIRSLEREKQEGLEKLASERDVLQRELEELKKKFEGMRSRNKLLSSEMKTLKSQMGTLVEKGRHDDELIDALMDQLKQLQEILGSLSLQEEKTRVSQHHLDQQLNSEAQRSNSLVAQLQAMVAEREAKVRQLEMEIGQLNVHYLRNKGVGEGSSGREVSPAYTQFLEDPGLTKSPASAGDHVGRLGSSRSVTSLGHTLVESALTRPSLPSPHRTSPRFSDSPEQKGWQAQVSEIKALWQAAEVERDRLTEFVTVLQKRVEESNSKLLESERKLQEERHRTVVLEQHLEKIRLEPGKASASQRAAPRTKTGLPTSNNRHNPTGSEKKDPSFAQLSDVPVESQMEELTTRLAIQVEENEMLKAALGSALRGKEEDFRMYHEILGQVKSVFLQALRQQKTGKQ

SEQ ID NO: 25919 - protein, 170 aa, Homo sapiens
  ENSP00000388649
MEDSSTDTEKEEEEEKDEKDQEPIYAIVPTINIQDERFVDLSETPAFIFLHELHAMGKLPGTRMAALKAKYTLLHDAVMSTQESEVQLLQNAKRFTEQIQQQQFHLQQADNFPEAFSTEVSKMREQLLKYQNEYNAVKEREFHNQYRLNSLKEEKIIIVKEFEKITKPGV

SEQ ID NO: 25920 - protein, 955 aa, Homo sapiens
  ENSP00000285871
MEDSSTDTEKEEEEEKDEKDQEPIYAIVPTINIQDERFVDLSETPAFIFLHELHAMGKLPGTRMAALKAKYTLLHDAVMSTQESEVQLLQNAKRFTEQIQQQQFHLQQADNFPEAFSTEVSKMREQLLKYQNEYNAVKEREFHNQYRLNSLKEEKIIIVKEFEKITKPGEMEKKMKILRESTEELRKEIMQKKLEIKNLREDLASKQKQLLKEQKELEELLGHQVVLKDEVAHHQTIPVQIGKEIEKITRKKVEMEKKKIVLEQEVKTLNDSLKKVENKVSAIVDEKENVIKEVEGKRALLEIKEREHNQLVKLLELARENEATSLTERGILDLNLRNSLIDKQNYHDELSRKQREKERDFRNLRKMELLLKVSWDALRQTQALHQRLLLEMEAIPKDDSTLSERRRELHKEVEVAKRNLAQQKIISEMESKLVEQQLAEENKLLKEQENMKELVVNLLRMTQIKIDEKEQKSKDFLKAQQKYTNIVKEMKAKDLEIRIHKKKKCEIYRRLREFAKLYDTIRNERNKFVNLLHKAHQKVNEIKERHKMSLNELEILRNSAVSQERKLQNSMLKHANNVTIRESMQNDVRKIVSKLQEMKEKKEAQLNNIDRLANTITMIEEEMVQLRKRYEKAVQHRNESGVQLIEREEEICIFYEKINIQEKMKLNGEIEIHLLEEKIQFLKMKIAEKQRQICVTQKLLPAKRSLDADLAVLQIQFSQCTDRIKDLEKQFVKPDGENRARFLPGKDLTEKEMIQKLDKLELQLAKKEEKLLEKDFIYEQVSRLTDRLCSKTQGCKQDTLLLAKKMNGYQRRIKNATEKMMALVAELSMKQALTIELQKEVREKEDFIFTCNSRIEKGLPLNKEIEKEWLKVLRDEEMHALAIAEKSQEFLEADNRQLPNGVYTTAEQRPNAYIPEADATLPLPKPYGALAPFKPSEPGANMRHIRKPVIKPVEI

SEQ ID NO: 25921 - protein, 254 aa, Homo sapiens
  ENSP00000354888
MDQSSEGCMKKISSVNLDKLINDFSQIEKKMVETNGKNNILDIQLEKSNCLLKVMQAKEVSIKEECATLHNIIKGLQQTIEYQQNLKGENEQLKISADLIKEKLKSHEQEYKNNIAKLVSEMKIKEEGYKKEISKLYQDMQRKVELNEEKHKELIEKKEMEISELNAKLRSQEKEKQNEIIKLQLEFDAKLARVQTKSKSYQDSTVLPQSIYRRKLQHFQEEKNKEIAILRNTIRDLEQRLSVGKDSHLKRRRF

SEQ ID NO: 25922 - protein, 198 aa, Homo sapiens
  ENSP00000373479
MDQSSEGCMKKISSVNLDKLINDFSQIEKKMVETNGKNNILDIQLEKSNCLLKVMQAKEVSIKEECATLHNIIKGLQQTIEYQQNLKVELNEEKHKELIEKKEMEISELNAKLRSQEKEKQNEIIKLQLEFDAKLARVQTKSKSYQDSTVLPQSIYRRKLQHFQEEKNKEIAILRNTIRDLEQRLSVGKDSHLKRRRF

SEQ ID NO: 25923 - protein, 562 aa, Homo sapiens
  ENSP00000404220
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQKQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 25924 - protein, 91 aa, Homo sapiens
  ENSP00000469367
MPVSLEEQILNSTFEACDPQRTGTVAVAQVLAYLEAVTGQGPQDARLQTLANSLDPNGEGPKATVDLDTFLVVMRDWIAACQLHGGLELEE

SEQ ID NO: 25925 - protein, 42 aa, Homo sapiens
  ENSP00000470765
MDLPEGPVGGPTAESAPEGETALLAGTPEQLLTHCGSSLTVE

SEQ ID NO: 25926 - protein, 75 aa, Homo sapiens
  ENSP00000468838
MPVSLEEQILNSTFEACDPQRTGTVAVAQVLAYLEAVTGQGPQDARLQTLANSLDPNGEGPKATVDLDTFLVVMR

SEQ ID NO: 25927 - protein, 188 aa, Homo sapiens
  ENSP00000471777
MYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEIL

SEQ ID NO: 25928 - protein, 193 aa, Homo sapiens
  ENSP00000469435
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEG

SEQ ID NO: 25929 - protein, 524 aa, Homo sapiens
  ENSP00000470819
  MOD_RES (1)..(1): Any amino acid
XNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 25930 - protein, 793 aa, Homo sapiens
  ENSP00000453940
MALSPWTPGLGAGEKLVQAAAVSTGPSLELCTLPSTLGSSVAVEALEQLFVVEQSLQSDYFKCNEEAKIFLKDIAVAVKKLEEMRKATIDLLEIESMELNKLYYLLETLPNSIKRELEECVRDARRLNLFEINTIKMRITRTENEIELLKKKITDLTKYNEALGEKQEELARKHARFVLSLNQTMEKKATTTVYINETYTKINLKREDIALQKKCIQEAEELMEKERAEYLIRKQELTAQINEFENTREVKRMETYQKKKELDKLQTKMSKIKETVTVSAAVLSDHNLEIARLHESIRYWEQEVSELKKDLAILEAKLCFFTDNKEKLDDISNDEKNEFLNKIKQLVETLHAARMEYKDLREKMKTLARQYKIVLSEEEKAFLQKQKIHDENQKQLTFISQKEYFLSQKRVDIKNMEEGLITLQELQQATKTVYQQQIKILSANLERESQRCVITQWKMACLRKKHARWTAKIKAEIQAITEKIQNAEVRRIELLNETSFRQQEISGFVAQIEKLTTELKEEEKAFVNKEKMLMKELSKYEEIFVKETQINKEKEEELVEYLPQLQVAEQEYKEKRRKLEELSNIITAQRQEEDLLNNHIFLFTRDFSRYISNMEDVKQELQQLRDQESKKNKDHFETLKNLENGFYINDQKADLLLLENKKLKEYILYLKNNIEKYREGQEALMHTSSDLSRQLIAQEAQYKDLWAEFQTTVKILVDNGEETLQDINNLTDKLRERDEKMQHVSTWLRGSLEGLRLLVEQESPMDLLKKKKHIRTRVHFPVVKCTEKNTLTK

SEQ ID NO: 25931 - protein, 828 aa, Homo sapiens
  ENSP00000452964
MALSPWTPGLGAGEKLVQAAAVSTGPSLELCTLPSTLGSSVAVEALEQLFVVEQSLQSDYFKCNEEAKIFLKDIAVAVKKLEEMRKATIDLLEIESMELNKLYYLLETLPNSIKRELEECVRDARRLNLFEINTIKMRITRTENEIELLKKKITDLTKYNEALGEKQEELARKHARFVLSLNQTMEKKATTTVYINETYTKINLKREDIALQKKCIQEAEELMEKERAEYLIRKQELTAQINEFENTREVKRMETYQKKKELDKLQTKMSKIKETVTVSAAVLSDHNLEIARLHESIRYWEQEVSELKKDLAILEAKLCFFTDNKEKLDDISNDEKNEFLNKIKQLVETLHAARMEYKDLREKMKTLARQYKIVLSEEEKAFLQKQKIHDENQKQLTFISQKEYFLSQKRVDIKNMEEGLITLQELQQATKTVYQQQIKILSANLERESQRCVITQWKMACLRKKHARWTAKIKAEIQAITEKIQNAEVRRIELLNETSFRQQEISGFVAQIEKLTTELKEEEKAFVNKEKMLMKELSKYEEIFVKETQINKEKEEELVEYLPQLQVAEQEYKEKRRKLEELSNIITAQRQEEDLLNNHIFLFTRDFSRYISNMEDVKQELQQLRDQESKKNKDHFETLKNLENGFYINDQKADLLLLENKKLKEYILYLKNNIEKYREGQEALMHTSSDLSRQLIAQEAQYKDLWAEFQTTVKILVDNGEETLQDINNLTDKLRERDEKMQHVSTWLRGSLEGLRLLVEQESPMDLLSKQQLRALLVTSKEEKTCQLSDLVIPNYATNIQLNIDTYLGLNTLVVLSNSAFHLREFSR

SEQ ID NO: 25932 - protein, 1701 aa, Homo sapiens
  ENSP00000434727
MRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDKSFETLADQTEWQSSHLFKYFQEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKQLRAGFFEHLEKWFDQCSLNTRVTVATKINELDSELELHLHLHQPRAQQIEKDIHNVRAAELLLHQEQLDSHCAGVTETLKKKRLMFCQFQEEQNVRSKNFRLKIYDMEHIFLNATRSQKLVTLSNTLHQELLSYVDVTQVSLRSFRQYLEESLGKLRYSNIEFIKHCRLFSEGGNFSPKEINSLCSRLEKEAARIELVESVIMLNMEKLENEYLDQANDVINKFESKFHNLSVDLIFIEKIQRLLTNLQVKIKCQVAKSNSQTNGLNFSLQQLQNKIKTCQESRGEKTTVTTEELLSFVQTWKEKLSQRIQYLNCSLDRVSMTELVFTNTILKDQEEDSDILTSSEALEEEAKLDVVTPESFTQLSRVGKPLIEDPAVDVIRKLLQLPNTKWPTHHCDKDPSQTGRGAWACGSRGSSEAGAGGAVCSPPVLCSCPGPSSPKGFKRHRCQPENSGKKAVPSASATSAGSFTPHPKPNKMERKYRVLGDKPPPAAEDFKGIILTLLWESSENLLTVAEEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKDKNAQKLHLNLGHPVHFQEMESLHLSEEERQEELDSMIRMNKEKLEECTRRNGQVFITNLATFTEKFLLQLDEVVTIDDVQVARMEPPKQKLSMLIRRKLAGLSLKEESEKPLIERGSRKWPGIKPTEVTIQNKILLQPTSSISTTKTTLGHLAAVEARDAVYLKYLASFEEELKRIQDDCTSQIKEAQRWKDSWKQSLHTIQGLYV

SEQ ID NO: 25933 - protein, 512 aa, Homo sapiens
  ENSP00000471454
MDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQVSRLASEKRELEAQLGRSREEALAGRAARQEAEALRGLVRGLELELRQERGLGHRVAGRRGQDCRRLAKELEEAKASERSLRARLKTLTSELALYKRGRRTPPVQPPPTREDRASSSRERSASRGRGAARSSSRESGRGSRGRGRPARPSPSPTGGRALRFDPTAFVKAKERKQREIQMKQQQRNRLGSGGSGDGPSVSWSRQTQPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 25934 - protein, 77 aa, Homo sapiens
  ENSP00000469909
MDQPAGLQVDYVFRGVEHAVRVMVSGQVLELEVEDRMTADQWRGEFDAGFIEDLTHKTGNFKQFNIFCHMLESALTQ

SEQ ID NO: 25935 - protein, 49 aa, Homo sapiens
  ENSP00000469524
MDQPAGLQVDYVFRGVEHAVRVMVSGQVLELEVEDRMTADQWRGEFDAG

SEQ ID NO: 25936 - protein, 332 aa, Homo sapiens
  ENSP00000469466
MDQPAGLQVDYVFRGVEHAVRVMVSGQVLELEVEDRMTADQWRGEFDAGFIEDLTHKTGNFKQFNIFCHMLESALTQSSESVTLDLLTYTDLESLRNRKMGGRPGSLAPRSAQLNSKRYLILIYSVEFDRIHYPLPLPYQGKPDPVVLQGIIRSLKEELGRLQGLDGQNTRDTRENEIWHLREQQQQRNRLGSGGSGDGPSVSWSRQTQPPAALTGRGDAPNRSRNRSSSVDSFRSRCSSASSCSDLEDFSESLSRGGHRRRGKPPSPTPWSGSNMKSPPVERSHHQKSLANSGGWVPIKEYSSEHQAADMAEIDARLKALQEYMNRLDMRS

SEQ ID NO: 25937 - protein, 332 aa, Homo sapiens; identical to SEQ ID NO: 25936
  ENSP00000444279

SEQ ID NO: 25938 - protein, 950 aa, Homo sapiens
  ENSP00000206423
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 25939 - protein, 950 aa, Homo sapiens; identical to SEQ ID NO: 25938
  ENSP00000411814

SEQ ID NO: 25940 - protein, 212 aa, Homo sapiens
  ENSP00000418188
MALRSMGQFSVFFFFFFWAQKKIASLSHSGFLHWFLLFEAVSSNGVLLFFSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGY

SEQ ID NO: 25941 - protein, 261 aa, Homo sapiens
  ENSP00000420123
  MOD_RES (1)..(1): Any amino acid
XFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGSSVVEREDVPAHLVKDIRNYFQVSPEYFSMLLVGKDGNVKSWYPSPMWSMVIVY

SEQ ID NO: 25942 - protein, 553 aa, Homo sapiens
  ENSP00000384040
MSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQASQNRRQPPTRNSSNMEKGWGSRARRVLQWWQGCRGIGRCLPTLPGSFRLSSGADGSNSSPNSAASFSGHATPSQQPEPVVHSLKVVWRKLGDAAGSCPGIRQHLSGNQYKGPM

SEQ ID NO: 25943 - protein, 1870 aa, Homo sapiens
  ENSP00000338728
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 25944 - protein, 1843 aa, Homo sapiens
  ENSP00000263630
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 25945 - protein, 374 aa, Homo sapiens
  ENSP00000413401
  MOD_RES (1)..(1): Any amino acid
XIMDQYKFYDPSPPRRRGNWITLKMRKLIKSKKDINRERQKSLTLTPTRSDSSEGFLQLPHQDSQDSSSVGSNSLEDGQTLGTKKSSNTTSFEDISPQGVSDDSSTGSRVHAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 25946 - protein, 888 aa, Homo sapiens
  ENSP00000390012
LLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 25947 - protein, 1202 aa, Homo sapiens
  ENSP00000405080
QLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASSEYHLHQWSSHILDIPTHTIGSCAQNDLAIDMPEPLYAQARNSRTGRSHFLNQTFATIRMPSDAFGMLAKDSIGPFTVAHSSQPFLSLNTELVSNISGLPPRPVIRITDQASASLDKPAQKENEQFSDHQNPSNSNLQFSINSNNLVTSACLYPDDTEAALLVSEDNQTVWYEYGCI

SEQ ID NO: 25948 - protein, 736 aa, Homo sapiens
  ENSP00000415267
  MOD_RES (1)..(1): Any amino acid
XKKSLEIKEEKIAALEARLEESTNYNQQLRQELKTNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSTMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKL

SEQ ID NO: 25949 - protein, 147 aa, Homo sapiens
  ENSP00000399237
MHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLH

SEQ ID NO: 25950 - protein, 1796 aa, Homo sapiens
  ENSP00000404431
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLASVISTAEGTTRRTSIHDFLTKDSRLPISVDSPPAAADSNTTAASNVDKVQESRNSKSRSREQQSS

SEQ ID NO: 25951 - protein, 741 aa, Homo sapiens [sequence omitted]

SEQ ID NO: 25952 - protein, 1871 aa, Homo sapiens
  ENSP00000410608
MENEIFTPLLEQFMTSPLVTWVKTFGPLAAGNGTNLDEYVALVDGVFLNQVMLQINPKLESQRVNKKVNNDASLRMHNLSILVRQIKFYYQETLQQLIMMSLPNVLIIGKNPFSEQGTEEVKKLLLLLLGCAVQCQKKEEFIERIQGLDFDTKAAVAAHIQEVTHNQENVFDLQWMEVTDMSQEDIEPLLKNMALHLKRLIDERDEHSETIIELSEERDGLHFLPHASSSAQSPCGSPGMKRTESRQHLSVELADAKAKIRRLRQELEEKTEQLLDCKQELEQMEIELKRLQQENMNLLSDARSARMYRDELDALREKAVRVDKLESEVSRYKERLHDIEFYKARVEELKEDNQVLLETKTMLEDQLEGTRARSDKLHELEKENLQLKAKLHDMEMERDMDRKKIEELMEENMTLEMAQKQSMDESLHLGWELEQISRTSELSEAPQKSLGHEVNELTSSRLLKLEMENQSLTKTVEELRTTVDSVEGNASKILKMEKENQRLSKKVEILENEIVQEKQSLQNCQNLSKDLMKEKAQLEKTIETLRENSERQIKILEQENEHLNQTVSSLRQRSQISAEARVKDIEKENKILHESIKETSSKLSKIEFEKRQIKKELEHYKEKGERAEELENELHHLEKENELLQKKITNLKITCEKIEALEQENSELERENRKLKKTLDSFKNLTFQLESLEKENSQLDEENLELRRNVESLKCASMKMAQLQLENKELESEKEQLKKGLELLKASFKKTERLEVSYQGLDIENQRLQKTLENSNKKIQQLESELQDLEMENQTLQKNLEELKISSKRLEQLEKENKSLEQETSQLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQAQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKISETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASNVDKVQESRNSKSRSREQQSS

SEQ ID NO: 25953 - protein, 115 aa, Homo sapiens
  ENSP00000335657
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 25954 - protein, 115 aa, Homo sapiens; identical to SEQ ID NO: 25953
  ENSP00000379472

SEQ ID NO: 25955 - protein, 115 aa, Homo sapiens; identical to SEQ ID NO: 25953
  ENSP00000409124

SEQ ID NO: 25956 - protein, 447 aa, Homo sapiens
  ENSP00000335544
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 25957 - protein, 363 aa, Homo sapiens
  ENSP00000432079
MELLKLNRSVQGTGPGPGASLCRPGAPLLNSSSVGNLSCEPPRIRGAGTRGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 25958 - protein, 136 aa, Homo sapiens
  ENSP00000437001
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGG

SEQ ID NO: 25959 - protein, 87 aa, Homo sapiens
  ENSP00000435675
MELLKLNRSVQGTGPGPGASLCRPGAPLLNSSSVGNLSCEPPRIRGAGTRDRTNTDLLNTRRRTELSQSSESPGLMPVFLIPRKMMR

SEQ ID NO: 25960 - protein, 516 aa, Homo sapiens
  ENSP00000435534
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGGAGPREQNLGEAELWRATGPAGVGGTEMKVRVRRKLEMELSWERRSGGDWAGDWGDSPFSLTAHPLCSGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 25961 - protein, 433 aa, Homo sapiens
  ENSP00000262659
MEYEVKKGKKGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEARAGGGGGGSLERQRAGARASGSWERRQTFSGSWERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRIMAPRTPLKHVTAARPHLLSMAPTAAAATTAVWAWSSYRITWSRCGVSWGPSRSSSLRCCCGSTGWGCPSRTIAQAC

SEQ ID NO: 25962 - protein, 324 aa, Homo sapiens
  ENSP00000392448
ERRHGGGGGGGGAGKPGGSWERRQAGSGGGGSWERRHPGPNPLDPQDPSPDAYCNLVILAVANRDAAEESCALICQVFQIIYGDQSIECVDRAGYHYTSTPERPWLCSRSESCHTDGTYAYDADFSCCSSFNGSQDTFEACYSGTSTPSFHGSHCSGSDHSSLGLEQLQDYMVTLRSKLGPLEIQQFAMLLREYRLGLPIQDYCTGLLKLYGDRRKFLLLGMRPFIPDQDIGYFEGFLEGVGIREGGILTDSFGRIKRSMSSTSASAVRSYDGAAQRPEAQAFHRLLADITHDIEALAPDDDDDDEDEPRGSRGGSDAAEDNYL

SEQ ID NO: 25963 - protein, 295 aa, Homo sapiens
  ENSP00000227507
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 25964 - protein, 67 aa, Homo sapiens
  ENSP00000438482
MEHQLLCCEVETIRRAYPDANLLNDRVLRAMLKAEETCAPSVSYFKCVQKEVLPSMRKIVATWMLEM

SEQ ID NO: 25965 - protein, 289 aa, Homo sapiens
  ENSP00000261254
MELLCHEVDPVRRAVRDRNLLRDDRVLQNLLTIEERYLPQCSYFKCVQKDIQPYMRRMVATWMLEVCEEQKCEEEVFPLAMNYLDRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATDFKFAMYPPSMIATGSVGAAICGLQQDEEVSSLTCDALTELLAKITNTDVDCLKACQEQIEAVLLNSLQQYRQDQRDGSKSEDELDQASTPTDVRDIDL

SEQ ID NO: 25966 - protein, 170 aa, Homo sapiens
  ENSP00000442807
  MOD_RES (1)..(1): Any amino acid
XRFLAGVPTPKSHLQLLGAVCMFLASKLKETSPLTAEKLCIYTDNSIKPQELLEWELVVLGKLKWNLAAVTPHDFIEHILRKLPQQREKLSLIRKHAQTFIALCATAQQVGQGKGKGCNQEMPQERLRGVSKSQRPAPDSISASFRVARRLLLLRHVCHVQHSSQTHSLD

SEQ ID NO: 25967 - protein, 255 aa, Homo sapiens
  ENSP00000426454
MPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEVCFTPKMNSKLFLLYILV

SEQ ID NO: 25968 - protein, 323 aa, Homo sapiens
  ENSP00000256897
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 25969 - protein, 249 aa, Homo sapiens
  ENSP00000426075
MPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 25970 - protein, 1021 aa, Homo sapiens
  ENSP00000358482
MAGISYVASFFLLLTKLSIGQREVTVQKGPLFRAEGYPVSIGCNVTGHQGPSEQHFQWSVYLPTNPTQEVQIISTKDAAFSYAVYTQRVRSGDVYVERVQGNSVLLHISKLQMKDAGEYECHTPNTDEKYYGSYSAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVMSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQVQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 25971 - protein, 1021 aa, Homo sapiens; identical to SEQ ID NO: 25970
  ENSP00000256652

SEQ ID NO: 25972 - protein, 260 aa, Homo sapiens
  ENSP00000266557
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 25973 - protein, 212 aa, Homo sapiens
  ENSP00000403331
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVSDGASWHPVCPADTSSQCGPPSCPIQHFQN

SEQ ID NO: 25974 - protein, 237 aa, Homo sapiens
  ENSP00000410126
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 25975 - protein, 310 aa, Homo sapiens
  ENSP00000375673
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVR

SEQ ID NO: 25976 - protein, 364 aa, Homo sapiens
  ENSP00000262262
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 25977 - protein, 208 aa, Homo sapiens
  ENSP00000395294
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGLFGFWNWGLKVKCFLRHLIWTAHCFIPLTQLVFMQALQSWRNHHCSHFTDEENRGVNR

SEQ ID NO: 25978 - protein, 193 aa, Homo sapiens
  ENSP00000245903
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 25979 - protein, 65 aa, Homo sapiens
  ENSP00000470805
MPEEGSGCSVRRRPYGCVLRAALVPLVAGLVICLVVCIQRFAQAQQQLPLESLGWDVAELQLNHT

SEQ ID NO: 25980 - protein, 160 aa, Homo sapiens
  ENSP00000367026
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQSHWNWRTRLLGWV

SEQ ID NO: 25981 - protein, 232 aa, Homo sapiens
  ENSP00000230685
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 25982 - protein, 316 aa, Homo sapiens
  ENSP00000430614
  MOD_RES (1)..(1): Any amino acid
XRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPGKGLAEGHLVTSSSSPAGPAPLWAGEGV

SEQ ID NO: 25983 - protein, 152 aa, Homo sapiens [sequence omitted]

SEQ ID NO: 25984 - protein, 296 aa, Homo sapiens
  ENSP00000009530
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 25985 - protein, 145 aa, Homo sapiens
  ENSP00000430654
  MOD_RES (1)..(1): Any amino acid
XRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQY

SEQ ID NO: 25986 - protein, 122 aa, Homo sapiens
  ENSP00000429641
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPHAECHQVWQHDRGPCDAPAPEC

SEQ ID NO: 25987 - protein, 52 aa, Homo sapiens
  ENSP00000429478
MHRRRSRSCREDQKPVMDDQRDLISNNEQLPMLGRRPGAPESPCRMPPSMAT

SEQ ID NO: 25988 - protein, 161 aa, Homo sapiens
  ENSP00000435682
MPLVINQSPPCCCVDDTWAQAEVGPVTSCTGFVEGSSRTGGMGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGI

SEQ ID NO: 25989 - protein, 267 aa, Homo sapiens
  ENSP00000227155
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIIELLGMVLSICLCRHVHSEDYSKVPKY

SEQ ID NO: 25990 - protein, 242 aa, Homo sapiens
  ENSP00000339686
MGSACIKVTKYFLFLFNLIFFILGAVILGFGVWILADKSSFISVLQTSSSSLRMGAYVFIGVGAVTMLMGFLGCIGAVNEVRCLLGLLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIIELLGMVLSICLCRHVHSEDYSKVPKY

SEQ ID NO: 25991 - protein, 108 aa, Homo sapiens
  ENSP00000431767
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYF

SEQ ID NO: 25992 - protein, 38 aa, Homo sapiens
  ENSP00000435661
MGSACIKVTKYFLFLFNLIFFILGAVILGFGVWILADK

SEQ ID NO: 25993 - protein, 179 aa, Homo sapiens
  ENSP00000433151
MARDWIRPQRASDCWSGKQQLFQIIIIIIISPPCCCVDDTWAQAEVGPVTSCTGFVEGSSRTGGMGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKVSP

SEQ ID NO: 25994 - protein, 68 aa, Homo sapiens
  ENSP00000436403
MGSACIKVTKYFLFLFNLIFFILGAVILGFGVWILADKSSFISVLQTSSSSLRMGAYVFIGVGAVTML

SEQ ID NO: 25995 - protein, 104 aa, Homo sapiens
  ENSP00000433804
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGA

SEQ ID NO: 25996 - protein, 157 aa, Homo sapiens
  ENSP00000433788
MEILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSC

SEQ ID NO: 25997 - protein, 57 aa, Homo sapiens
  ENSP00000433036
DNSLSVRKGFCEAPGNRTQSGNHPEDWPVYQELLGMVLSICLCRHVHSEDYSKVPKY

SEQ ID NO: 25998 - protein, 205 aa, Homo sapiens
  ENSP00000368450
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 25999 - protein, 146 aa, Homo sapiens
  ENSP00000480760
METPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 26000 - protein, 228 aa, Homo sapiens
  ENSP00000371958
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 26001 - protein, 141 aa, Homo sapiens
  ENSP00000440985
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRE

SEQ ID NO: 26002 - protein, 228 aa, Homo sapiens
  ENSP00000371959
MPVKGGTKCIKYLLFGFNFIFWLAGIAVLAIGLWLRFDSQTKSIFEQETNNNNSSFYTGVYILIGAGALMMLVGFLGCCGAVQESQCMLGLATKRTMFPPFLEDHVCFFSLNPQFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAV

SEQ ID NO: 26003 - protein, 228 aa, Homo sapiens; identical to SEQ ID NO: 26000
  ENSP00000009180

SEQ ID NO: 26004 - protein, 159 aa, Homo sapiens
  ENSP00000371955
MMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 26005 - protein, 182 aa, Homo sapiens
  ENSP00000478288
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYAVELLWFGWGRGTVYLRHLPQEGRTRNLHREVLS

SEQ ID NO: 26006 - protein, 514 aa, Homo sapiens
  ENSP00000251108
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 26007 - protein, 153 aa, Homo sapiens
  ENSP00000434135
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNGLLEAAKMPR

SEQ ID NO: 26008 - protein, 102 aa, Homo sapiens
  ENSP00000434986
MKEAGQMQNLESARAGRSVSTQTGSMTGQIPRLSKVNLFTLLSLWMELFPAEAQRQKSQKNEEGKHGPLGDNEERTRVSTDKRQKTMFCLFENDCKWITGSS

SEQ ID NO: 26009 - protein, 97 aa, Homo sapiens
  ENSP00000389571
  MOD_RES (1)..(1): Any amino acid
XGQMQNLESARAGRSVSTQTGSMTGQIPRLSKVNLFTLLSLWMELFPAEAQRQKSQKNEEGKHGPLGDNEERTRVSTDKRQDYWKQLRCLDERFTIT

SEQ ID NO: 26010 - protein, 471 aa, Homo sapiens
  ENSP00000417897
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTDGWLSQAVTFLDRLLIWLGIHKD

SEQ ID NO: 26011 - protein, 480 aa, Homo sapiens
  ENSP00000413940
ERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 26012 - protein, 498 aa, Homo sapiens
  ENSP00000364389
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 26013 - protein, 459 aa, Homo sapiens
  ENSP00000364388
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTLSISRTKTVLR

SEQ ID NO: 26014 - protein, 461 aa, Homo sapiens
  ENSP00000364390
MSREGAGAALVAEVIKDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 26015 - protein, 485 aa, Homo sapiens
  ENSP00000420572
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTCPLAVLTSALCSVVIWWIVCDYILPILLFCLDGFRTQ

SEQ ID NO: 26016 - protein, 268 aa, Homo sapiens
  ENSP00000396951
  MOD_RES (1)..(1): Any amino acid
XMLWSHEPGGRGGSFGSRGDQRKEHCNFSISDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGST

SEQ ID NO: 26017 - protein, 228 aa, Homo sapiens
  ENSP00000400480
APRRGLEKEGVTLVAFEPAGKTNVRVVTFEKSQPARADRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHS

SEQ ID NO: 26018 - protein, 391 aa, Homo sapiens
  ENSP00000249014
MPGPQGGRGAATMSLGKLSPVGWVSSSQGKRRLTADMISHPLGDFRHTMHVGRGGDVFGDTSFLSNHGGSSGSTHRSPRSFLAKKLQLVRRVGAPPRRMASPPAPSPAPPAISPIIKNAISLPQLNQAAYDSLVVGKLSFDSSPTSSTDGHSSYGLDSGFCTISRLPRSEKPHDRDRDGSFPSEPGLRRSDSLLSFRLDLDLGPSLLSELLGVMSLPEAPAAETPAPAANPPAPTANPTGPAANPPATTANPPAPAANPSAPAATPTGPAANPPAPAASSTPHGHCPNGVTAGLGPVAEVKSSPVGGGPRGPAGPALGRHWGAGWDGGHHYPEMDARQERVEVLPQARASWESLDEEWRAPQAGSRTPVPSTVQANTFEFADAEEDDEVKV

SEQ ID NO: 26019 - protein, 70 aa, Homo sapiens
  ENSP00000411682
MPGPQGGRGAATMSLGKLSPVGWVSSSQGKRRLTADMISHPLGDFRHTMHVGRGGDVFGDTSFLSNHGGS

SEQ ID NO: 26020 - protein, 60 aa, Homo sapiens
  ENSP00000405006
MPGPQGGRGAATMSLGKLSPVGWVSSSQGKRRLTADMISHPLGDFRHTMHVGRGGDVFGD

SEQ ID NO: 26021 - protein, 48 aa, Homo sapiens
  ENSP00000403710
MPGPQGGRGAATMSLGKLSPVGWVSSSQGKRRLTADMISHPLGDFRHT

SEQ ID NO: 26022 - protein, 254 aa, Homo sapiens
  ENSP00000295324
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKGKTKSEESLSDLTGSLLSLQLDLGPSLLDEVLNVMDKNK

SEQ ID NO: 26023 - protein, 215 aa, Homo sapiens
  ENSP00000403298
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIK

SEQ ID NO: 26024 - protein, 34 aa, Homo sapiens
  ENSP00000398062
MPAKTPIYLKAANNKKGKKFKLRDILSPDMISPP

SEQ ID NO: 26025 - protein, 14 aa, Homo sapiens
  ENSP00000409147
MPAKTPIYLKAANN

SEQ ID NO: 26026 - protein, 254 aa, Homo sapiens; identical to SEQ ID NO: 26022
  ENSP00000480549

SEQ ID NO: 26027 - protein, 356 aa, Homo sapiens
  ENSP00000338258
MPILKQLVSSSVHSKRRSRADLTAEMISAPLGDFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 26028 - protein, 286 aa, Homo sapiens
  ENSP00000404270
MPILKQLVSSSVHSKRRSRADLTAEMISAPLGDFRHTMHVGRAGDAFGDTSFLNSKAAEKGTSKLPKSLSSSPVKKANDGEGGDEEAGTEEAVPRRNGAAGPHSPDPLLDEQAFGDLTDLPVVPKATYGLKHAESIMSFHIDLGPSMLGDVLSIMDKEEWDPEEGEGGYHGDEGAAGTITQAPPYAVAAPPLARQEGKAGPDLPSLPSHALEDEGWAAAAPSPGSARSMGSHTTRDSSSLSSCTSGILEERSPAFRGPDRARAAVSRQPDKEFSFMDEEEEDEIRV

SEQ ID NO: 26029 - protein, 79 aa, Homo sapiens
  ENSP00000464104
MPILKQLVSSSVHSKRRSRADLTAEMISAPLGDFRHTMHQLPLQLHLRHPGGAQPCLPGAGQGPGCCLKTARQGVLLHG

SEQ ID NO: 26030 - protein, 127 aa, Homo sapiens
  ENSP00000462231
MPILKQLVSSSVHSKRRSRADLTAEMISAPLGDFRHTMHVGRAGDAFGDTSFLNSKAGEPDGESLDEQPSSSSSKRSLLSRKFRGSKRSQSVTRGEREQRDMLGSLRDSALFVKNAMSLPQLNEKEA

SEQ ID NO: 26031 - protein, 73 aa, Homo sapiens
  ENSP00000463877
MPILKQLVSSSVHSKRRSRADLTAEMISAPLGDFRHTMHVGRAGDAFGDTSFLNSKAGEPDGESLDEQPSSSS

SEQ ID NO: 26032 - protein, 79 aa, Homo sapiens; identical to SEQ ID NO: 26029
  ENSP00000485861

SEQ ID NO: 26033 - protein, 882 aa, Homo sapiens
  ENSP00000261769
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 26034 - protein, 537 aa, Homo sapiens
  ENSP00000454782
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITFSSCYWNRDTSADPV

SEQ ID NO: 26035 - protein, 821 aa, Homo sapiens
  ENSP00000414946
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 26036 - protein, 414 aa, Homo sapiens
  ENSP00000458139
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKVCMVPGKMQKLASSQLFIPLSPGLGF

SEQ ID NO: 26037 - protein, 155 aa, Homo sapiens
  ENSP00000463170
  MOD_RES (1)..(1): Any amino acid
XTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTEPL

SEQ ID NO: 26038 - protein, 647 aa, Homo sapiens [sequence omitted]

SEQ ID NO: 26039 - protein, 647 aa, Homo sapiens
  ENSP00000480664
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNLASQSIGITDMSHCTCPAPQLPAIF

SEQ ID NO: 26040 - protein, 903 aa, Homo sapiens
  ENSP00000481063
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKVWYLARCRNWHPHSCSYPCPLGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 26041 - protein, 788 aa, Homo sapiens
  ENSP00000264463
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 26042 - protein, 436 aa, Homo sapiens
  ENSP00000425653
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRQSQRDNTRGCFCENFGC

SEQ ID NO: 26043 - protein, 693 aa, Homo sapiens
  ENSP00000377711
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLGCPSLMEPPSPREDMRLLYLGFQLMLFSYVKVNRRFCLLGVFIKLPFLYVVATESPTTLTSL

SEQ ID NO: 26044 - protein, 796 aa, Homo sapiens
  ENSP00000268603
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 26045 - protein, 670 aa, Homo sapiens
  ENSP00000457812
MAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 26046 - protein, 62 aa, Homo sapiens
  ENSP00000484650
  MOD_RES (1)..(1): Any amino acid
XMSVSEAAVPGEEVGRVKAKDPDIGENGLVTYNIVDGDGMESFEITTDYETQEGVIKLKKVS

SEQ ID NO: 26047 - protein, 222 aa, Homo sapiens
  ENSP00000455779
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALP

SEQ ID NO: 26048 - protein, 70 aa, Homo sapiens
  ENSP00000455420
MKENYCLQAALVCLGMLCHSHAFAPERRGHLRPSFHGHHEKGKEGQVLQRSKRGWVWNQFFVIEEYTGPD

SEQ ID NO: 26049 - protein, 65 aa, Homo sapiens
  ENSP00000456772
MKENYCLQAALVCLGMLCHSHAFAPERRGHLRPSFHGHHEKGKEGQVLQRSKRGWVWNQFFVIEE

SEQ ID NO: 26050 - protein, 53 aa, Homo sapiens
  ENSP00000455120
MKENYCLQAALVCLGMLCHSHAFAPERRGHLRPSFHGHHEKGKEGQVLQRSKR

SEQ ID NO: 26051 - protein, 34 aa, Homo sapiens
  ENSP00000455697
MKENYCLQAALVCLGMLCHSHAFAPERRGHLRPS

SEQ ID NO: 26052 - protein, 22 aa, Homo sapiens
  ENSP00000456110
MKENYCLQAALVCLGMLCHSHA

SEQ ID NO: 26053 - protein, 52 aa, Homo sapiens
  ENSP00000442225
MQPRTPLVLCVLLSQVLLLTSAEDLDCTPGFQQKVFHINQPAEFIEDQSILN

SEQ ID NO: 26054 - protein, 67 aa, Homo sapiens
  ENSP00000456297
MQPRTPLVLCVLLSQVLLLTSAEDLDCTPGFQQKVFHINQPAEFIEDQSILNCKQCHSKMLLDSSHI

SEQ ID NO: 26055 - protein, 713 aa, Homo sapiens
  ENSP00000479395
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 26056 - protein, 760 aa, Homo sapiens
  ENSP00000268613
MKTPPGASSRTKCSRELRSFCAFSCPRAKQPTCTAWFPQQEHPSENGPQMPGRDPPAASTMQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 26057 - protein, 56 aa, Homo sapiens
  ENSP00000457914
MQPRTPLVLCVLLSQVLLLTSAEDLDCTPGFQQKVFHINQPAEFIEDQSILNYVFY

SEQ ID NO: 26058 - protein, 67 aa, Homo sapiens
  ENSP00000455781
MQPRTPLVLCVLLSQTPVRPTIYLCQNLQFIKNKARDSNSLADHKGKRIQVNRLLPGLLFHDELSGI

SEQ ID NO: 26059 - protein, 37 aa, Homo sapiens
  ENSP00000457149
MQPRTPLVLCVLLSQSGGPVCKSQFQALPLAVQWLGV

SEQ ID NO: 26060 - protein, 175 aa, Homo sapiens
  ENSP00000456491
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKMKIWQVLCLARWLT

SEQ ID NO: 26061 - protein, 190 aa, Homo sapiens
  ENSP00000408632
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKRTHNPINSELLLNEGITADLNPCITILAI

SEQ ID NO: 26062 - protein, 674 aa, Homo sapiens
  ENSP00000394557
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 26063 - protein, 814 aa, Homo sapiens
  ENSP00000289746
MDAAFLLVLGLLAQSLCLSLGVPGWRRPTTLYPWRRAPALSRVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYDEQGGGEEDQDAYDISQLRHPTALSLPLGPPPLRRDAPQGRLHPQPPRVLPTSPLDIADFINDGLEAADSDPSVPPYDTALIYDYEGDGSVAGTLSSILSSQGDEDQDYDYLRDWGPRFARLADMYGHPCGLEYGARWDHQAREGLSPGALLPRHRGRTA

SEQ ID NO: 26064 - protein, 772 aa, Homo sapiens
  ENSP00000262150
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 26065 - protein, 541 aa, Homo sapiens
  ENSP00000463085
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQELVLTFKKNLSSTSPS

SEQ ID NO: 26066 - protein, 490 aa, Homo sapiens
  ENSP00000439593
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQGLFF

SEQ ID NO: 26067 - protein, 434 aa, Homo sapiens
  ENSP00000401998
GIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEK

SEQ ID NO: 26068 - protein, 65 aa, Homo sapiens
  ENSP00000464477
MNCYLLLRFMLGIPLLWPCLGATENSQTKKVKQPVRSHLRVKRGWVWNQFFVPEEMNTTSHHIGQ

SEQ ID NO: 26069 - protein, 906 aa, Homo sapiens
  ENSP00000269141
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 26070 - protein, 875 aa, Homo sapiens
  ENSP00000382312
MFLLRRYVCIFTEKLKNQAELYVFLSVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 26071 - protein, 191 aa, Homo sapiens
  ENSP00000411360
MCNTQRMKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDI

SEQ ID NO: 26072 - protein, 120 aa, Homo sapiens
  ENSP00000412120
MVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQP

SEQ ID NO: 26073 - protein, 73 aa, Homo sapiens
  ENSP00000414269
MVYAVRSFPLSSEHAKFLIYAQDKETQEKWQVAVKLSLKPTLTEESVKESAEVEEIVFPRQFSKHSGHLQRQK

SEQ ID NO: 26074 - protein, 3359 aa, Homo sapiens
  ENSP00000224721
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPEVGATGNTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 26075 - protein, 530 aa, Homo sapiens
  ENSP00000473454
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 26076 - protein, 1061 aa, Homo sapiens
  ENSP00000299366
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGAAPASAHLCRPPGALPPPLPDGQPD

SEQ ID NO: 26077 - protein, 1381 aa, Homo sapiens
  ENSP00000482036
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITVRGWGQGAPFLPI

SEQ ID NO: 26078 - protein, 954 aa, Homo sapiens
  ENSP00000473539
  MOD_RES (1)..(1): Any amino acid
XDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEENGGWLQGRPEGVGEGLHVQNLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQAAPALASEGSLLDHLQSLPD

SEQ ID NO: 26079 - protein, 165 aa, Homo sapiens
  ENSP00000480146
  MOD_RES (1)..(1): Any amino acid
XDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLWEKFFCSNSSRFSSAQLVVSSWNQL

SEQ ID NO: 26080 - protein, 803 aa, Homo sapiens
  ENSP00000388894
  MOD_RES (1)..(1): Any amino acid
XDIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQEDLASPCISPAPPRRAFQSSGEKETSQFPGKELRREPGPSKAQNRAAFTEPLAEAPLLGSKQAQEERAPLPREQAQQLQGSEGEKGGP

SEQ ID NO: 26081 - protein, 1079 aa, Homo sapiens
  ENSP00000478374
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKLIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 26082 - protein, 1114 aa, Homo sapiens
  ENSP00000381768
MVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 26083 - protein, 3354 aa, Homo sapiens
  ENSP00000483211
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDETQGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVQVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 26084 - protein, 445 aa, Homo sapiens
  ENSP00000381822
MDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNALAIIITNLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDEGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLVSPRFTAGPLSSPGPTVVRHPEGFCPRDLSNQGRRHPQIPELCLLVY

SEQ ID NO: 26085 - protein, 1380 aa, Homo sapiens
  ENSP00000381789
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQAATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITVRGWGQGAPFLPI

SEQ ID NO: 26086 - protein, 832 aa, Homo sapiens
  ENSP00000339390
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 26087 - protein, 444 aa, Homo sapiens
  ENSP00000360030
  MOD_RES (1)..(1): Any amino acid
XRPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 26088 - protein, 124 aa, Homo sapiens
  ENSP00000244049
MKPLIWTWSDVEGQRPALLICTAAAGPTQGVKAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 26089 - protein, 165 aa, Homo sapiens
  ENSP00000310845
MKPLIWTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 26090 - protein, 80 aa, Homo sapiens
  ENSP00000407939
MKPLIWTWSDVEGQRPALLICTAAAGPTQGVKGYGKPFEPRSVKNIHSTPAYPDATMHRQLLAPVEGRMAETLNQKLHVA

SEQ ID NO: 26091 - protein, 566 aa, Homo sapiens
  ENSP00000486680
KVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICERPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 26092 - protein, 566 aa, Homo sapiens; identical to SEQ ID NO: 26091
  ENSP00000487355

SEQ ID NO: 26093 - protein, 566 aa, Homo sapiens; identical to SEQ ID NO: 26091
  ENSP00000486568

SEQ ID NO: 26094 - protein, 916 aa, Homo sapiens
  ENSP00000484928
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 26095 - protein, 822 aa, Homo sapiens
  ENSP00000480844
MPKSTGMLHGGRENAGVKFSSCVGTKGTQYETNSMDFKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 26096 - protein, 842 aa, Homo sapiens
  ENSP00000443301
MDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 26097 - protein, 785 aa, Homo sapiens
  ENSP00000319166
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLVLILLIVTMRRRKKEPLIFDEERDIRENIVRYDDEGGGEEDTEAFDMAALRNLNVIRDTKTRRDVTPEIQFLSRPAFKSIPDNVIFREFIWERLKEADVDPGAPPYDSLQTYAFEGNGSVAESLSSLDSISSNSDQNYDYLSDWGPRFKRLADMYGTGQESLYS

SEQ ID NO: 26098 - protein, 630 aa, Homo sapiens
  ENSP00000443030
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLGRYCFQGLL

SEQ ID NO: 26099 - protein, 785 aa, Homo sapiens; identical to SEQ ID NO: 26097
  ENSP00000381058

SEQ ID NO: 26100 - protein, 744 aa, Homo sapiens
  ENSP00000462018
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRWGLPIQWWEERNPIQTCLFSRSRIPRSLLFIFFHKDTKINCITQWTT

SEQ ID NO: 26101 - protein, 476 aa, Homo sapiens
  ENSP00000463266
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEISHSNC

SEQ ID NO: 26102 - protein, 799 aa, Homo sapiens
  ENSP00000462701
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRKDIKPDLQFMPRQGLAPVPNGVDVDEFINVRLHEADNDPTAPPYDSIQIYGYEGRGSVAGSLSSLESTTSDSDQNFDYLSDWGPRFKRLGELYSVGESDKET

SEQ ID NO: 26103 - protein, 745 aa, Homo sapiens
  ENSP00000299345
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRKDIKPDLQFMPRLQKRVARRNITRCCLKRKTVENHGFNELRGQDQKRK

SEQ ID NO: 26104 - protein, 532 aa, Homo sapiens
  ENSP00000463511
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVNISMLLMLNMFVYNCLIFD

SEQ ID NO: 26105 - protein, 425 aa, Homo sapiens
  ENSP00000462976
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPI

SEQ ID NO: 26106 - protein, 81 aa, Homo sapiens
  ENSP00000462847
MPERLAEMLLDLWTPLIILWITLPPCIYMAPMNQSQVLMSGSPLELNSLGEEQRILNRSKRGWVWNQMFVLEEFSGPEPIL

SEQ ID NO: 26107 - protein, 859 aa, Homo sapiens
  ENSP00000485478
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 26108 - protein, 745 aa, Homo sapiens
  ENSP00000331063
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAEVRRLRYMKNSNFPGTTKSVRKPKFKPKKPHSSQGLFLHPHCEIALFNLSNVNLYSRVFQGAAQAS

SEQ ID NO: 26109 - protein, 598 aa, Homo sapiens
  ENSP00000361189
  MOD_RES (1)..(1): Any amino acid
XITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 26110 - protein, 48 aa, Homo sapiens
  ENSP00000485460
  MOD_RES (1)..(1): Any amino acid
XMDGDRGKPNRILYSLVNDFPRQCRTILWHDSPAPPCGPVQNFRVHLP

SEQ ID NO: 26111 - protein, 135 aa, Homo sapiens
  ENSP00000485151
  MOD_RES (1)..(1): Any amino acid
XENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKP

SEQ ID NO: 26112 - protein, 78 aa, Homo sapiens
  ENSP00000485245
  MOD_RES (1)..(1): Any amino acid
XITHAEPANVFDINSHTGEIWLKNSIRSLDALHNITPGRDCLWSLEVQAKDRGSPSFSTTALLKIDITDAEVRRLRSN

SEQ ID NO: 26113 - protein, 127 aa, Homo sapiens
  ENSP00000393616
MSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEG

SEQ ID NO: 26114 - protein, 127 aa, Homo sapiens; identical to SEQ ID NO: 26113
  ENSP00000410770

SEQ ID NO: 26115 - protein, 127 aa, Homo sapiens; identical to SEQ ID NO: 26113
  ENSP00000394570

SEQ ID NO: 26116 - protein, 127 aa, Homo sapiens; identical to SEQ ID NO: 26113
  ENSP00000406848

SEQ ID NO: 26117 - protein, 469 aa, Homo sapiens
  ENSP00000369390
MCDLIEPQPAEKIGKMKKLRRTLSESFSRIALKKDDTTFDEICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 26118 - protein, 92 aa, Homo sapiens
  ENSP00000401603
MSTRNCQGMDSVIKPLDTIPEDKKVRVQRTQSTFDPFEKPANQVKRVHSENNACINFKTSSTGKESPKVRRHSSPSSPTSPKFGKADSYEKL

SEQ ID NO: 26119 - protein, 451 aa, Homo sapiens
  ENSP00000265741
MHGYFGCNAAAEPGYSAFVGTPQICVTKMSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 26120 - protein, 423 aa, Homo sapiens
  ENSP00000385034
MSTRNCQGMDSVIKPLDTIPEDKKVRVQRTQSTFDPFEKPANQVKRVHSENNACINFKTSSTGKESPKVRRHSSPSSPTSPKFGKADSYEKLEKLGEGSYATVYKGKSKVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 26121 - protein, 113 aa, Homo sapiens
  ENSP00000387794
MSTRNCQGMDSVIKPLDTIPEDKKVRVQRTQSTFDPFEKPANQVKRVHSENNACINFKTSSTGKESPKVRRHSSPSSGKWEVGSSEGDQAAGRRRDTFHSYQGSFSFKRTKTC

SEQ ID NO: 26122 - protein, 340 aa, Homo sapiens
  ENSP00000398936
MLALTLRPPPLAKSHLKLGGTPAPARVNGKLVALKVIRLQEEEGTPFTAIREASLLKGLKHANIVLLHDIIHTKETLTLVFEYVHTDLCQYMDKHPGGLHPDNVKLFLFQLLRGLSYIHQRYILHRDLKPQNLLISDTGELKLADFGLARAKSVPSHTYSNEVVTLWYRPPDVLLGSTEYSTCLDMWGVGCIFVEMIQGVAAFPGMKDIQDQLERIFLVLGTPNEDTWPGVHSLPHFKPERFTLYSSKNLRQAWNKLSYVNHAEDLASKLLQCSPKNRLSAQAALSHEYFSDLPPRLWELTDMSSIFTVPNVRLQPEAGESMRAFGKNNSYGKSLSNSKH

SEQ ID NO: 26123 - protein, 54 aa, Homo sapiens
  ENSP00000389831
MTSFHPRGLQAARAQKFKSKRPRSNSDCFQEEDLRQGFQWSRGRASLLGQPHLT

SEQ ID NO: 26124 - protein, 384 aa, Homo sapiens
  ENSP00000386901
MTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDEESLFTVSGVRLKPEMCDLLASYQKGHHPAQFSKCW

SEQ ID NO: 26125 - protein, 384 aa, Homo sapiens; identical to SEQ ID NO: 26124
  ENSP00000260967

SEQ ID NO: 26126 - protein, 429 aa, Homo sapiens
  ENSP00000406472
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDVSGVRLKPEMCDLLASYQKGHHPAQFSKCW

SEQ ID NO: 26127 - protein, 400 aa, Homo sapiens
  ENSP00000412775
MGQELCAKTVQPGCSCYHCSEGGEAHSCRRSQPETTEAAFKLTDLKEASCSMTSFHPRGLQAARAQKFKSKRPRSNSDCFQEEDLRQGFQWRKSLPFGAASSYLNLEKLGEGSYATVYKGISRINGQLVALKVISMNAEEGVPFTAIREASLLKGLKHANIVLLHDIIHTKETLTFVFEYMHTDLAQYMSQHPGGLHPHNVRLFMFQLLRGLAYIHHQHVLHRDLKPQNLLISHLGELKLADFGLARAKSIPSQTYSSEVVTLWYRPPDALLGATEYSSELDIWGAGCIFIEMFQGQPLFPGVSNILEQLEKIWEVLGVPTEDTWPGVSKLPNYNPEWFPLPTPRSLHVVWNRLGRVPEAEDLASQMLKGFPRDRVSAQEALVHDYFSALPSQLYQLPDE

SEQ ID NO: 26128 - protein, 502 aa, Homo sapiens
  ENSP00000405798
MQSEIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 26129 - protein, 57 aa, Homo sapiens
  ENSP00000431085
MDRMKKIKRQLSMTLRGGRGIDKTNGAPEQIGLDESGGGGGSDPGEAPTRAAPGELR

SEQ ID NO: 26130 - protein, 83 aa, Homo sapiens
  ENSP00000430966
MQSEIAMDRMKKIKRQLSMTLRGGRGIDKTNGAPEQIGLDESGGGGGSDPGEAPTRAAPGELRSARGPLSSAPDCARGLEDGV

SEQ ID NO: 26131 - protein, 496 aa, Homo sapiens [sequence omitted]

SEQ ID NO: 26132 - protein, 150 aa, Homo sapiens
  ENSP00000429259
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLR

SEQ ID NO: 26133 - protein, 153 aa, Homo sapiens
  ENSP00000428351
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVS

SEQ ID NO: 26134 - protein, 393 aa, Homo sapiens
  ENSP00000429985
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILVFCAMKPCSQPFRDR

SEQ ID NO: 26135 - protein, 189 aa, Homo sapiens
  ENSP00000429044
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDN

SEQ ID NO: 26136 - protein, 496 aa, Homo sapiens [sequence omitted]

SEQ ID NO: 26137 - protein, 152 aa, Homo sapiens
  ENSP00000430486
  MOD_RES (1)..(1): Any amino acid
XPEQIGLDESGGGGGSDPGEAPTRAAPGELRSARGPLSSAPEIVHEDLKMGSDGESDQASATSSDEVQSPVRDINKRLSLPADIRLPEGYLEKLTLNSPIFDKPLSRRLRRVSLSEIGFGKLETYIKLDKLGEGTYATVYKGKSKLTDNLVA

SEQ ID NO: 26138 - protein, 260 aa, Homo sapiens
  ENSP00000428349
DKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRSLCPCGRLDSDGADLLTKLLQFEGRNRISAEDAMKHPFFLSLGERIHKLPDTTSIFALKEIQLQKEASLRSSSMPDSGRPAFRVVDTEF

SEQ ID NO: 26139 - protein, 166 aa, Homo sapiens
  ENSP00000430988
  MOD_RES (1)..(1): Any amino acid
XLDSDGADLLTKLLQFEGRNRISAEDAMKHPFFLSLGERIHKLPDTTSIFALKEIQLQKEASLRSSSMPDSAICSAFPHRQASFPRGGHRVLSHRPRPQQAAAGGMPHPSQGSPQLHLPCLLSAYLPEPCSPAHLSPAACPNTPPLACQPTHWPVCWVLTKLSSLL

SEQ ID NO: 26140 - protein, 84 aa, Homo sapiens
  ENSP00000430824
  MOD_RES (1)..(1): Any amino acid
XLDSDGADLLTKLLQFEGRNRISAEDAMKHPFFLSLGERIHKLPDTTSIFALKEIQLQKEASLRSSSMPDSVAGGQHGRASLPH

SEQ ID NO: 26141 - protein, 570 aa, Homo sapiens
  ENSP00000276052
MPLYGRARDHVTHPSILGTRPGRPMAGPITAAVPEKICNGAFCSCSGAFPLDPNNPSLGPLPSISHLNLRTQIAMDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 26142 - protein, 448 aa, Homo sapiens
  ENSP00000482886
MDRMKKIKRQLSMTLRSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 26143 - protein, 474 aa, Homo sapiens
  ENSP00000399082
MIMNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 26144 - protein, 72 aa, Homo sapiens [sequence omitted]

SEQ ID NO: 26145 - protein, 72 aa, Homo sapiens [sequence omitted]

SEQ ID NO: 26146 - protein, 504 aa, Homo sapiens
  ENSP00000423665
MIMNKMKNFKRRFSLSVPRTETIEESLAEFTEQFNQLHNRRNENLQLGPLGRDPPQECSTFSPTDSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 26147 - protein, 474 aa, Homo sapiens; identical to SEQ ID NO: 26143
  ENSP00000353176

SEQ ID NO: 26148 - protein, 72 aa, Homo sapiens [sequence omitted]

SEQ ID NO: 26149 - protein, 180 aa, Homo sapiens
  ENSP00000423408
MEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQ

SEQ ID NO: 26150 - protein, 159 aa, Homo sapiens
  ENSP00000397831
MIMNKMKNFKRRFSLSVPRTETIEESLAEFTEQFNQLHNRRNENSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKL

SEQ ID NO: 26151 - protein, 64 aa, Homo sapiens
  ENSP00000426368
MEVRASGALPRQVAGCTHKGVHRRAAALQPDFDVSKRLSLPMDIRLPQEFLQKLQMESPDLPKP

SEQ ID NO: 26152 - protein, 283 aa, Homo sapiens
  ENSP00000391324
MIMNKMKNFKRRFSLSVPRTETIEESLAEFTEQFNQLHNRRNENLQLGPLGRDPPQECSTFSPTDSGEEPGQLSPGVQFQRRQNQRRFSMEVRASGALPRQVAGCTHKGVHRRAAALQPDFDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGL

SEQ ID NO: 26153 - protein, 72 aa, Homo sapiens [sequence omitted]

SEQ ID NO: 26154 - protein, 298 aa, Homo sapiens
  ENSP00000266970
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 26155 - protein, 39 aa, Homo sapiens
  ENSP00000450983
MENFQKVEKIGEGTYGVVYKARNKLTGEVVALKKIRLDT

SEQ ID NO: 26156 - protein, 346 aa, Homo sapiens
  ENSP00000452514
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMHLVGTQHHARCCGEHRRNGRQSLCPLCSYLEVAASQGWGMTAVSTPYPVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 26157 - protein, 238 aa, Homo sapiens
  ENSP00000393605
MENFQKVEKIGEGTYGVVYKARNKLTGEVVALKKIRLDTLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 26158 - protein, 39 aa, Homo sapiens; identical to SEQ ID NO: 26155
  ENSP00000452138

SEQ ID NO: 26159 - protein, 264 aa, Homo sapiens
  ENSP00000243067
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 26160 - protein, 367 aa, Homo sapiens
  ENSP00000304250
MGTVLSLSPASSAKGRRPGGLPEEKKKAPPAGDEALGGYGAPPVGKGGKGESRLKRPSVLISALTWKRLVAASAKKKKGSKKVTPKPASTGPDPLVQQRNRENLLRKGRDPPDGGGTAKPLAVPVPTVPAAAATCEPPSGGSAAAQPPGSGGGKPPPPPPPAPQVAPPVPGGSPRRVIVQASTGELLRCLGDFVCRRCYRLKELSPGELVGWFRGVDRSLLLQGWQDQAFITPANLVFVYLLCRESLRGDELASAAELQAAFLTCLYLAYSYMGNEISYPLKPFLVEPDKERFWQRCLRLIQRLSPQMLRLNADPHFFTQVFQDLKNEGEAAASGGGPPSGGAPAASSAARDSCAAGTKHWTMNLDR

SEQ ID NO: 26161 - protein, 1893 aa, Homo sapiens
  ENSP00000343818
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 26162 - protein, 1814 aa, Homo sapiens
  ENSP00000353317
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTELLASKEDEDTIKIGEDDEINFLSDQHLQQSNEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLRDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 26163 - protein, 460 aa, Homo sapiens
  ENSP00000419265
MMDLVLEEDVTVPGTLSGCSGLVPSVPDDLDGINPNAGLGNVLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRGLTLFPGLFLNSWAQVILPPQFLE

SEQ ID NO: 26164 - protein, 749 aa, Homo sapiens
  ENSP00000418418
MMDLVLEEDVTVPGTLSGCSGLVPSVPDDLDGINPNAGLGNVLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTETSLTYSYIFMLHTFLGCIFTPFHAPCSFWLARRTRTRSKLGRMTRLIS

SEQ ID NO: 26165 - protein, 1287 aa, Homo sapiens
  ENSP00000400395
DSINNLQAELNKIFALRKQLEQDVLSYQNLRKTLEEQISEIRRREEESFSLYSDQTSYLSICLEENNRFQVEHFSQEELKKKVSDLIQLVKELYTDNQHLKKTIFDLSCMGFQGNGFPDRLASTEQTEIMKDLSKGGCKNGYLRHTESKISDCDGAHAPGCLEEGAFINLLAPLFNEKATLLLESRPDLLKVVRELLLGQLFLTEQEVSGEHLDGKTEKTPKQKGELVHFVQTNSFSKPHDELKLSCEAQLVKAGEVPKVGLKDASVQTVATEGDLLRFKHEATREAWEEKPINTALSAEHRPENLHGVPGWQAALLSLPGITNREAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 26166 - protein, 903 aa, Homo sapiens
  ENSP00000409941
NMYRLPATQEVVTQLQSQILELQGELKEFKTCNKQLHQKLILAEAVMEGRPTPDKTLLNDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 26167 - protein, 133 aa, Homo sapiens
  ENSP00000419640
MACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEAL

SEQ ID NO: 26168 - protein, 275 aa, Homo sapiens
  ENSP00000417925
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETE

SEQ ID NO: 26169 - protein, 1663 aa, Homo sapiens
  ENSP00000354065
MMDLVLEEDVTVPGTLSGCSGLVPSVPDDLDGINPNAGLGNGLLPNVSEETVSPTRARNMKDFENQITELKKENFNLKLRIYFLEERMQQEFHGPTEHIYKTNIELKVEVESLKRELQEREQLLIKASKAVESLAEAGGSEIQRVKEDARKKVQQVEDLLTKRILLLEKDVTAAQAELEKAFAGTETEKALRLRLESKLSEMKKMHEGDLAMALVLDEKDRLIEELKLSLKSKEALIQCLKEEKSQMACPDENVSSGELRGLCAAPREEKERETEAAQMEHQKERNSFEERIQALEEDLREKEREIATEKKNSLKRDKAIQGLTMALKSKEKKVEELNSEIEKLSAAFAKAREALQKAQTQEFQGSEDYETALSGKEALSAALRSQNLTKSTENHRLRRSIKKITQELSDLQQERERLEKDLEEAHREKSKGDCTIRDLRNEVEKLRNEVNEREKAMENRYKSLLSESNKKLHNQEQVIKHLTESTNQKDVLLQKFNEKDLEVIQQNCYLMAAEDLELRSEGLITEKCSSQQPPGSKTIFSKEKKQSSDYEELIQVLKKEQDIYTHLVKSLQESDSINNLQAELNKIFALRKQLEQDVLSYQNLRKTLEEQISEIRRREESFSLYSDQTSYLSICLEENNRFQVEHFSQEELKKKVSDLIQLVKELYTDNQHLKKTIFDLSCMGFQGNGFPDRLASTEQTEEAKKSRLPILIKPSRSLGNMYRLPATQEVVTQLQSQILELQGELKEFKTCNKQLHQKLILAEAVMEGRPTPDKTLLNAQPPVGAAYQDSPGEQKGIKTTSSVWRDKEMDSDQQRSYEIDSEICPPDDLASLPSCKENPEDVLSPTSVATYLSSKSQPSAKVSVMGTDQSESINTSNETEYLKQKIHDLETELEGYQNFIFQLQKHSQCSEAIITVLCGTEGAQDGLSKPKNGSDGEEMTFSSLHQVRYVKHVKILGPLAPEMIDSRVLENLKQQLEEQEYKLQKEQNLNMQLFSEIHNLQNKFRDLSPPRYDSLVQSQARELSLQRQQIKDGHGICVISRQHMNTMIKAFEELLQASDVDYCVAEGFQEQLNQCAELLEKLEKLFLNGKSVGVEMNTQNELMERIEEDNLTYQHLLPESPEPSASHALSDYETSEKSFFSRDQKQDNETEKTSVMVNSFSQDLLMEHIQEIRTLRKRLEESIKTNEKLRKQLERQGSEFVQGSTSIFASGSELHSSLTSEIHFLRKQNQALNAMLIKGSRDKQKENDKLRESLSRKTVSLEHLQREYASVKEENERLQKEGSEKERHNQQLIQEVRCSGQELSRVQEEVKLRQQLLSQNDKLLQSLRVELKAYEKLDEEHRRLREASGEGWKGQDPFRDLHSLLMEIQALRLQLERSIETSSTLQSRLKEQLARGAEKAQEGALTLAVQAVSIPEVPLQPDKHDGDKYPMESDNSFDLFDSSQAVTPKSVSETPPLSGNDTDSLSCDSGSSATSTPCVSRLVTGHHLWASKNGRHVLGLIEDYEALLKQISQGQRLLAEMDIQTQEAPSSTSQELGTKGPHPAPLSKFVSSVSTAKLTLEEAYRRLKLLWRVSLPEDGQCPLHCEQIGEMKAEVTKLHKKLFEQEKKLQNTMKLLQLSKRQEKVIFDQLVVTHKILRKARGNLELRPGGAHPGTCSPSRPGS

SEQ ID NO: 26170 - protein, 358 aa, Homo sapiens
  ENSP00000379176
MMEKYEKIGKIGEGSYGVVFKCRNRDTGQIVAIKKFLESEDDPVIKKIALREIRMLKQLKHPNLVNLLEVFRRKRRLHLVFEYCDHTVLHELDRYQRGVPEHLVKSITWQTLQAVNFCHKHNCIHRDVKPENILITKHSVIKLCDFGFARLLTGPSDYYTDYVATRWYRSPELLVGDTQYGPPVDVWAIGCVFAELLSGVPLWPGKSDVDQLYLIRKTLGDLIPRHQQVFSTNQYFSGVKIPDPEDMEPLELKFPNISYPALGLLKGCLHMDPTQRLTCEQLLHHPYFENIREIEDLAKEHNKPTRKTLRKSRKHHCFTETSKLQYLPQLTGSSILPALDNKKYYCDTKKLNYRFPNI

SEQ ID NO: 26171 - protein, 70 aa, Homo sapiens
  ENSP00000431449
  MOD_RES (1)..(1): Any amino acid
XDLIPRHQQVFSTNQYFSGVKIPDPEDMEPLELKFPNISYPALGLLKLQYLPQLTGSSILPALDNKKYYC

SEQ ID NO: 26172 - protein, 140 aa, Homo sapiens
  ENSP00000435044
  MOD_RES (1)..(1): Any amino acid
XAIGCVFAELLSGVPLWPGKSDVDQLYLIRKTLGDLIPRHQQVFSTNQYFSGVKIPDPEDMEPLELKFPNISYPALGLLKGCLHMDPTQRLTCEQLLHHPYFENIREIEDLAKEHNKPTRKTLRKSRKHHCFTETSKVII

SEQ ID NO: 26173 - protein, 276 aa, Homo sapiens
  ENSP00000216378
MMEKYEKIGKIGEGSYGVVFKCRNRDTGQIVAIKKFLESEDDPVIKKIALREIRMLKQLKHPNLVNLLEVFRRKRRLHLVFEYCDHTVLHELDRYQRGVPEHLVKSITWQTLQAVNFCHKHNCIHRDVKPENILITKHSVIKLCDFGFARLLTGPSDYYTDYVATRWYRSPELLVGDTQYGPPVDVWAIGCVFAELLSGVPLWPGKSDVDQLYLIRKTLGDLIPRHQQVFSTNQYFSGVKIPDPEDMEPLELKFPNISYPALGLLKGRVPIASRTE

SEQ ID NO: 26174 - protein, 164 aa, Homo sapiens
  ENSP00000244741
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 26175 - protein, 164 aa, Homo sapiens; identical to SEQ ID NO: 26174
  ENSP00000362815

SEQ ID NO: 26176 - protein, 164 aa, Homo sapiens; identical to SEQ ID NO: 26174
  ENSP00000384849

SEQ ID NO: 26177 - protein, 164 aa, Homo sapiens; identical to SEQ ID NO: 26174
  ENSP00000482768

SEQ ID NO: 26178 - protein, 164 aa, Homo sapiens; identical to SEQ ID NO: 26174
  ENSP00000409259

SEQ ID NO: 26179 - protein, 200 aa, Homo sapiens
  ENSP00000250535
MEQTEVLKPRTLADLIRILHQLFAGDEVNVEEVQAIMEAYESDPTEWAMYAKFDQYRYTRNLVDQGNGKFNLMILCWGEGHGSSIHDHTNSHCFLKMLQGNLKETLFAWPDKKSNEMVKKSERVLRENQCAYINDSIGLHRVENISHTEPAVSLHLYSPPFDTCHAFDQRTGHKNKVTMTFHSKFGIRTPNATSGSLENN

SEQ ID NO: 26180 - protein, 598 aa, Homo sapiens
  ENSP00000330512
MTFQASHRSAWGKSRKKNWQYEGPTQKLFLKRNNVSAPDGPSDPSISVSSEQSGAQQPPALQVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 26181 - protein, 171 aa, Homo sapiens
  ENSP00000394740
MLAYNNGSRSGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAV

SEQ ID NO: 26182 - protein, 544 aa, Homo sapiens
  ENSP00000380718
MASEELYEVERIVDKRKNKKGKTEYLVRWKGYDSEDDTWEPEQHLVNCEEYIHDFNRRHTEKQKESTLTRTNRTSPNNARKQISRSTNSNFSKTSPKALVIGKDHESKNSQLFAASQKFRKNTAPSLSSRKNMDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 26183 - protein, 412 aa, Homo sapiens
  ENSP00000394076
MDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGMDSMLKYLQRKIDEF

SEQ ID NO: 26184 - protein, 412 aa, Homo sapiens; identical to SEQ ID NO: 26183
  ENSP00000340908

SEQ ID NO: 26185 - protein, 506 aa, Homo sapiens
  ENSP00000476295
MASGDLYEVERIVDKRKNKKGKWEYLIRWKGYGSTEDTWEPEHHLLHCEEFIDEFNGLHMSKDKRIKSGKQSSTSKLLRDSRGPSVEKLSHRPSDPGKSKGTSHKRKRINPPLAKPKKGYSGKPSSGGDRATKTVSYRTTPSGLQIMPLKKSQNGMENGDAGSEKDERHFGNGSHQPGLDLNDHVGEQDMGECDVNHATLAENGLGSALTNGGLNLHSPVKRKLEAEKDYVFDKRLRYSVRQNESNCRFRDIVVRKEEGFTHILLSSQTSDNNALTPEIMKEVRRALCNAATDDSKLLLLSAVGSVFCSGLDYSYLIGRLSSDRRKESTRIAEAIRDFVKAFIQFKKPIVVAINGPALGLGASILPLCDIVWASEKAWFQTPYATIRLTPAGCSSYTFPQILGVALANEMLFCGRKLTAQEACSRGLVSQVFWPTTFSQEVMLRVKEMASCSAVVLEESKCLVRSFLKSVLEDVNEKECLMLKQLWSSSKGLDSLFSYLQDKIYEV

SEQ ID NO: 26186 - protein, 507 aa, Homo sapiens
  ENSP00000454546
MASGDLYEVERIVDKRKNKKGKWEYLIRWKGYGSTEDTWEPEHHLLHCEEFIDEFNGLHMSKDKRIKSGKQSSTSKLLRDSRGPSVEKLSHRPSDPGKSKGTSHKRKRINPPLAKPKKGYSGKPSSGGDRATKTVSYRTTPSGLQIMPLKKSQNGMENGDAGSEKDERHFGNGSHQPGLDLNDHVGEQDMGECDVNHATLAENGLGGSALTNGGLNLHSPVKRKLEAEKDYVFDKRLRYSVRQNESNCRFRDIVVRKEEGFTHILLSSQTSDNNALTPEIMKEVRRALCNAATDDSKLLLLSAVGSVFCSGLDYSYLIGRLSSDRRKESTRIAEAIRDFVKAFIQFKKPIVVAINGPALGLGASILPLCDIVWASEKAWFQTPYATIRLTPAGCSSYTFPQILGVALANEMLFCGRKLTAQEACSRGLVSQVFWPTTFSQEVMLRVKEMASCSAVVLEESKCLVRSFLKSVLEDVNEKECLMLKQLWSSSKGLDSLFSYLQDKIYEV

SEQ ID NO: 26187 - protein, 507 aa, Homo sapiens; identical to SEQ ID NO: 26186
  ENSP00000455111

SEQ ID NO: 26188 - protein, 507 aa, Homo sapiens; identical to SEQ ID NO: 26186
  ENSP00000456934

SEQ ID NO: 26189 - protein, 345 aa, Homo sapiens
  ENSP00000305422
MQRLVAWDPACLPLPPPPPAFKSMEVANFYYEADCLAAAYGGKAAPAAPPAARPGPRPPAGELGSIGDHERAIDFSPYLEPLGAPQAPAPATATDTFEAAPPAPAPAPASSGQHHDFLSDLFSDDYGGKNCKKPAEYGYVSLGRLGAAKGALHPGCFAPLHPPPPPPPPPAELKAEPGFEPADCKRKEEAGAPGGGAGMAAGFPYALRAYLGYQAVPSGSSGSLSTSSSSSPPGTPSPADAKAPPTACYAGAAPAPSQVKSKAKKTVDKHSDEYKIRRERNNIAVRKSRDKAKMRNLETQHKVLELTAENERLQKKVEQLSRELSTLRNLFKQLPEPLLASSGHC

SEQ ID NO: 26190 - protein, 1361 aa, Homo sapiens
  ENSP00000220244
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 26191 - protein, 1361 aa, Homo sapiens; identical to SEQ ID NO: 26190
  ENSP00000378177

SEQ ID NO: 26192 - protein, 1361 aa, Homo sapiens; identical to SEQ ID NO: 26190
  ENSP00000348583

SEQ ID NO: 26193 - protein, 145 aa, Homo sapiens
  ENSP00000453066
  MOD_RES (1)..(1): Any amino acid
XRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSG

SEQ ID NO: 26194 - protein, 76 aa, Homo sapiens
  ENSP00000431426
  MOD_RES (1)..(1): Any amino acid
XINFNKGDWIRVGLCYPRGTTFSILSDVHNRLLKQTSKTGVFVRTLQMDKVEQSYPGRSHYYWDEDSGKQRTISWR

SEQ ID NO: 26195 - protein, 1117 aa, Homo sapiens
  ENSP00000263468
MLAGRPGTRSAVGELGTESSDNLDRAPLGPRESGGHHRPGSYLDMKIHLEKNLEEERQILLQQQKICRNRARKYFVESNRRKKAFEEKRKEQEEKEHQIREQILQQRKQKFEEVTEKFQRAHVPLSQRRKAVSRKPVPPLEEALKQIQESNLKSEVNLPFSRRPTINWRAIDSALPSALSKNDHKHQKQLLSKINCEKEMNENMRATLATSKNVFQLKLEETQKLLEDQHLSNLQKFCDEVNQITNSETLSSIDSLEATEHEEIYLTLNKEHSTSIQRNTISLKPANMQSTNLSCFDEDKLAFSKTQHINNWLTNLDASNTQNVTAFSDILSKSNVLPSWEYFNSKEQNPSPLNGTVERATNTANNSVPFVSSPPMFVLDKKCEKTSETSTMRTTDSTSGAFKRERPLVTESPTFKFSKSQSTSDSLTQEVATFPDQEKYSELNQENGTTSIPTSCVPVATPLVLPSNIQSARPSAKNSIHIKEIDAVQCSDKLDELKDGKEEEIKYFNCNKEELPLFSDSFQDAYIPHNPDSKDEKQKLAETSSLSNVTSNYDFVGQHKKMKYNIHERNGVRFLKSILKKESKYEHGYLKALIINQSFKFGNQKAAAIRDSIELTKEKGAEIPKTIKKLRWFDETSNIENNAENSHSLKNKTGTTQQHSQQFHIQSGAGSNIISVSTCAVNSADTKKSREDSISENVTTLGGSGADHMPLNCFIPSGYNFAKHAWPASKKEESKIPVHDDSKTKQGKPQRGRAKIIRKPGSAKVQSGFICTNRKGAVIQPQSASKVNIFTQAQGKLIIPCPPPQSTSNIRSGKNIQVSQCQPVTPENPQNIITHNSFNSKHVLPTEHSLNQWNQESSSPLSNACSDLVTVIPSLPSYCSSECQTFAKINHSNGTQAVARQDATLYCTQRSPVCEESYPSVTLRTAEEESVPLWKRGPNVLHQNKRATGSTVMRRKRIAETKRRNILEQKRQNPGSVGQKYSEQINNFGQSVLLSSSEPKQTTRGTSYIEEVSDSTSEFLMAENLVKASVPEDEILTVLNSKQIQKSNLPLNKTQQFNICTLSAEEQKILESLNDLSERLHYIQESICKNPSIKNTLQIIPLLEKREDRTSSCRDKR

SEQ ID NO: 26196 - protein, 432 aa, Homo sapiens
  ENSP00000433643
  MOD_RES (1)..(1): Any amino acid
XAHVPLSQRRKAVSRKPVPPLEEALKQIQESNLKSEVNLPFSRRPTINWRSIPACPAVSTPDPYLPDQLSPPRVPLRSHHFQILPSYPTVSPARQPHILPIHPSVPSTLPKTFAPVPLLPYPIKYHPCPPTPATSSISSSFPRLPAPIPSCPPGHPPHAPQSSPIIPDPESQHKLFYKTFRPKHFLPAQHSTAATLMPTLVRRSLPAPLVVSPTPLEPLPVLKPSCLSSHPPYPPVPTLSYVTPLPAHPASLDPFQSVQQSVPQATALSNQPEAFADHPPASVLSLASPCHSPSSSLPSSPSTSTSFSSACILFSSSSSILSSSSTSCSTSPSLPPSSIPLFSSPLHSSSSPGLPPTYLAFPSPVSPVSSSFMISSSFPPILHSPSVSTSPSPFIPIHPFNPPHWGKKVEKRREESGVEKKGIEKKVETRQL

SEQ ID NO: 26197 - protein, 81 aa, Homo sapiens
  ENSP00000437014
  MOD_RES (1)..(1): Any amino acid
XEQKRQNPGSVGQKYSEQINNFGQSVLLSSSEPKQTTRGTSYIEEDIQESICKNPSIKNTLQIIPLLEKREDRTSSCRDKR

SEQ ID NO: 26198 - protein, 74 aa, Homo sapiens
  ENSP00000464760
MSLPPEKASELKQLIHQQLSKMDVHGRIREILAETIREELAPDQQHLSTEDLIKALRRRGIIDDVMKELNFVTC

SEQ ID NO: 26199 - protein, 659 aa, Homo sapiens
  ENSP00000262127
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 26200 - protein, 584 aa, Homo sapiens
  ENSP00000403074
MSLPPEKASELKQLIHQQLSKMDVHGRIREILAETIREELAPDQQHLSTEDLIKALRRRGIIDDVMKELNFVTDSVEQELPSSPKQPICFDRQSTLKKSDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 26201 - protein, 178 aa, Homo sapiens
  ENSP00000464911
NIKLEMYPPLNQTLSQEVVNTQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLG

SEQ ID NO: 26202 - protein, 74 aa, Homo sapiens; identical to SEQ ID NO: 26198
  ENSP00000466689

SEQ ID NO: 26203 - protein, 101 aa, Homo sapiens
  ENSP00000467361
  MOD_RES (1)..(1): Any amino acid
XWRSVLGSENGVTSLTVELMGTESKVSVGILNIKLEMYPPLNQTLSQEVVNTQLALERQKTAEKERLFLVYAKQWWREYLQIRPSHNSRLVKIFAQVCKLY

SEQ ID NO: 26204 - protein, 191 aa, Homo sapiens
  ENSP00000467224
EPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQVCKLY

SEQ ID NO: 26205 - protein, 112 aa, Homo sapiens
  ENSP00000466833
MSLPPEKASELKQLIHQQLSKMDVHGRIREILAETIREELAPDQQHLSTEDLIKALRRRGIIDDVMKELNFVTDSVEQELPSSPKQPICFDRQSTLKKSFGWKSFLGTSART

SEQ ID NO: 26206 - protein, 416 aa, Homo sapiens
  ENSP00000349696
MSGHRSTRKRCGDSHPESPVGFGHMSTTGCVLNKLFQLPTPPLSRHQLKRLEEHRYQSAGRSLLEPLMQGYWEWLVRRVPSWIAPNLITIIGLSINICTTILLVFYCPTATEQAPLWAYIACACGLFIYQSLDAIDGKQARRTNSSSPLGELFDHGCDSLSTVFVVLGTCIAVQLGTNPDWMFFCCFAGTFMFYCAHWQTYVSGTLRFGIIDVTEVQIFIIIMHLLAVIGGPPFWQSMIPVLNIQMKIFPALCTVAGTIFSCTNYFRVIFTGGVGKNGSTIAGTSVLSPFLHIGSVITLAAMIYKKSAVQLFEKHPCLYILTFGFVSAKITNKLVVAHMTKSEMHLHDTAFIGPALLFLDQYFNSFIDEYIVLWIALVFSFFDLIRYCVSVCNQIASHLHIHVFRIKVSTAHSNHH

SEQ ID NO: 26207 - protein, 416 aa, Homo sapiens; identical to SEQ ID NO: 26206
  ENSP00000441980

SEQ ID NO: 26208 - protein, 280 aa, Homo sapiens [sequence omitted]

SEQ ID NO: 26209 - protein, 64 aa, Homo sapiens
  ENSP00000402508
MLQEWLAAVGDDYAAVVWRPEGEPRFYPDEEGPKHWTKERHQFLMELKQEALTFARNWGADYIL

SEQ ID NO: 26210 - protein, 517 aa, Homo sapiens
  ENSP00000361933
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 26211 - protein, 109 aa, Homo sapiens
  ENSP00000402928
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQ

SEQ ID NO: 26212 - protein, 218 aa, Homo sapiens
  ENSP00000416676
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALG

SEQ ID NO: 26213 - protein, 595 aa, Homo sapiens
  ENSP00000361929
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 26214 - protein, 79 aa, Homo sapiens
  ENSP00000403766
MLQEWLAAVGDDYAAVVWRPEGEPRFYPDEEGPKHWTKERHQFLMELKQEALTFARNWGADYILFADTDNILTNNQTLR

SEQ ID NO: 26215 - protein, 155 aa, Homo sapiens
  ENSP00000478713
MTAKQCPGAGHYCPESRGGGCWQGLQILSDLATTLGMATLPSGPVFHREKPLRDGSHSLKVSQQRSRTPRPLYPAWPDSGPCGPQLVSSWADPRIPSLPKDSAEGPLCPFYLHLSTLPQLDVWVSPAPSSLAGAKYREVKQDPCRHVAQHTVGPQ

SEQ ID NO: 26216 - protein, 517 aa, Homo sapiens [sequence omitted]

SEQ ID NO: 26217 - protein, 532 aa, Homo sapiens
  ENSP00000386725
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 26218 - protein, 514 aa, Homo sapiens
  ENSP00000387080
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAVMEYEGHALSLLKECELQGFDGGHRKPLFAIHWSVQRLFTGMQTLEPSVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 26219 - protein, 419 aa, Homo sapiens
  ENSP00000364108
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 26220 - protein, 173 aa, Homo sapiens
  ENSP00000409198
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAVLSVLVEMDLLAK

SEQ ID NO: 26221 - protein, 558 aa, Homo sapiens
  ENSP00000341159
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTIMEYEGHALSLLKECELQGFDGGHRKPLFAIHWSVQRLFTGMQTLEPSVVCVGGDGSASEVAHALLLRAQKNAGMETDRILTPVRAQLPLGLIPAGSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 26222 - protein, 463 aa, Homo sapiens
  ENSP00000364109
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTRSTNVLAHSLHGVPHVITATLHIIMGHVQLVDVCTFSTAGKLLRFGFSAMFGFGGRTLALAEKYRWMSPNQRRDFAVVKALAKLKAEDCEISFLPFNSSDDVQERRAQGSPKSDCNDQWQMIQGQFLNVSIMAIPCLCSVAPRGLAPNTRLNNGSMALIIARNTSRPEFIKHLKRYASVKNQFNFPFVETYTVEEVKVHPRNNTGGYNPEEEEDETASENCFPWNVDGDLMEVASEVHIRLHPRLISLYGGSMEEMIPK

SEQ ID NO: 26223 - protein, 217 aa, Homo sapiens
  ENSP00000364106
MPWRRRRNRVSALEGGREEEAPPEAAAVPPALLTSPQQTEAAAERILLRGIFEIGRDSCDVVLSERALRWRPIQPERPAGDSKYDLLCKEEFIELKDIFSVKLKRRCSVKQQRSGTLLGITLFICLKKEQNKLKNSTLDLINLSEDHCDIWFRQFKKILAGFPNRPKSLKILLNPQSHKKEATQVYYEKVEPLLKLAGIKTDVTMLSVLVEMDLLAK

SEQ ID NO: 26224 - protein, 173 aa, Homo sapiens; identical to SEQ ID NO: 26220
  ENSP00000411466

SEQ ID NO: 26225 - protein, 92 aa, Homo sapiens
  ENSP00000453796
MLSSFNEWFWQDRFWLPPNVTWTELEDRDGRVYPHPQDLLAALPLALVLLAMRLAFERFIGLPLSRWLGVRDQTRRQVKPNATLEKHFLTEG

SEQ ID NO: 26226 - protein, 113 aa, Homo sapiens
  ENSP00000453388
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQ

SEQ ID NO: 26227 - protein, 343 aa, Homo sapiens
  ENSP00000452753
MRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGAAGGPRPAPTDGPRSRVAGRLTNRHTTAT

SEQ ID NO: 26228 - protein, 136 aa, Homo sapiens
  ENSP00000452910
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEA

SEQ ID NO: 26229 - protein, 394 aa, Homo sapiens
  ENSP00000251363
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGAAGGPRPAPTDGPRSRVAGRLTNRHTTAT

SEQ ID NO: 26230 - protein, 394 aa, Homo sapiens; identical to SEQ ID NO: 26229
  ENSP00000453509

SEQ ID NO: 26231 - protein, 306 aa, Homo sapiens
  ENSP00000453815
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEMEKDIRSDVEESDSSEEAAAAQEPLQLKNGAAGGPRPAPTDGPRSRVAGRLTNRHTTAT

SEQ ID NO: 26232 - protein, 31 aa, Homo sapiens
  ENSP00000452920
MLSSFNEWFWQDRFWLPPNVTWTELEDRDGR

SEQ ID NO: 26233 - protein, 192 aa, Homo sapiens
  ENSP00000454122
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLS

SEQ ID NO: 26234 - protein, 111 aa, Homo sapiens
  ENSP00000453414
MKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDA

SEQ ID NO: 26235 - protein, 105 aa, Homo sapiens
  ENSP00000454135
MKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIIL

SEQ ID NO: 26236 - protein, 301 aa, Homo sapiens
  ENSP00000286732
MAQNVYGPGVRIGNWNEDVYLEEELMKDFLEKRDKGKLLIQRSRRLKQNLLRPMQLSVTEDGYIHYGDKVMLVNPDDPDTEADVFLRGDLSLCMTPDEIQSHLKDELEVPCGLSAVQAKTPIGRNTFIILSVHRDATGQVLRYGQDFCLGITGGFDNKMLYLSSDHRTLLKSSKRSWLQEVYLTDEVSHVNCWQAAFPDPQLRLEYEGFPVPANAKILINHCHTNRGLAAHRHLFLSTYFGKEAEVVAHTYLDSHRVEKPRNHWMLVTGNPRDASSSMLDLPKPPTEDTRAMEQAMGLDTQ

SEQ ID NO: 26237 - protein, 193 aa, Homo sapiens
  ENSP00000262498
MFKNTFQSGFLSILYSIGSKPLQIWDKKVRNGHIKRITDNDIQSLVLEIEGTNVSTTYITCPADPKKTLGIKLPFLVMIIKNLKKYFTFEVQVLDDKNVRRRFRASNYQSTTRVKPFICTMPMRLDDGWNQIQFNLLDFTRRAYGTNYIETLRVQIHANCRIRRVYFSDRLYSEDELPAEFKLYLPVQNKAKQ

SEQ ID NO: 26238 - protein, 108 aa, Homo sapiens
  ENSP00000455220
MFKNTFQSGFLSILYSIGSKPLQIWDKKVRNGHIKRITDNDIQSLVLEIEGTNVSTTYITCPADPKKTLGIKLPFLVMIIKNLKKYFTFEVQMTRMCVVAFGQVTTRA

SEQ ID NO: 26239 - protein, 269 aa, Homo sapiens
  ENSP00000295220
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESKTYVIPLQCSCPVDFEFYITLIQSHQAFAIEPTSGIIPANGKMTVTIKFTPFQYGTAQIKMQLWISQFNSQPYECVFTGTCYPNMALPSLSQL

SEQ ID NO: 26240 - protein, 134 aa, Homo sapiens
  ENSP00000470662
MAVVKTPSRGLKNAKEPFNNASPHLLKNLVEEPKKRKEVPNHLLESKVYAKLVNNKVIQARPGIIHFGGYQVEKQHQQILFTEKAHWHDVPWNCLRHYLVEISLPAPSLCLLTAFSAIHHVDHSSLLPQTPGLK

SEQ ID NO: 26241 - protein, 53 aa, Homo sapiens
  ENSP00000391760
MAVVKTPSRGLKNAKEPFNNASPHLLKNLVEEPKKRKEVPNHLLESTSGQCFQ

SEQ ID NO: 26242 - protein, 175 aa, Homo sapiens
  ENSP00000409912
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGE

SEQ ID NO: 26243 - protein, 90 aa, Homo sapiens
  ENSP00000470784
MAVVKTPSRGLKNAKEPFNNASPHLLKNLVEEPKKRKEVPNHLLESKVYAKLVNNKVIQARPGIIHFGGYQVEKQHQQILVLAGSPVLGV

SEQ ID NO: 26244 - protein, 840 aa, Homo sapiens
  ENSP00000393222
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESKTYVIPLQCSCPVDFEFYITLIQSHQAFAIEPTSGIIPANGKMTVTIKFTPFQYGTAQIKMQLWISQFNSQPYECVFTGTCYPNMALPLEEFERLNTLSKKVNVPPEKAMMHINFHRPPAKPKPQKVKEIEYQNLRFPVDLSNPFAVATVLNQEPGKLKIKELREVLDQGTEISKTRQMKEALFEQKVRQDIHEEMENHLKWQVHLGKDPMSFKLKKELTEEWQKACAKYKLDRGDPILDEEFQRLKTEVSHKRVVRNQEEKIKEFHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSVLSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 26245 - protein, 187 aa, Homo sapiens
  ENSP00000472563
MAVVKTPSRGLKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGESLPNSVFLVPDN

SEQ ID NO: 26246 - protein, 173 aa, Homo sapiens
  ENSP00000470283
  MOD_RES (1)..(1): Any amino acid
XKNAKEPFNNASPHLLKNLVEEPKKRKEVPNHLLESKVYAKLVNNKVIQARPGIIHFGGYQVEKQHQQILHLVNVSNEDTRVHILPPQTKYFEINYVRKEHHLVPGLSLTVTVTFSPDEWRYYYDCIRVHCKGDDTLLVPIHAYPVMNSLDFPSFINLSNVLLGERIRKHLTE

SEQ ID NO: 26247 - protein, 46 aa, Homo sapiens
  ENSP00000472069
VIPLQCSCPVDFEFYITLIQSHQAFAIEPTSGTRSIIYAHLPGILC

SEQ ID NO: 26248 - protein, 118 aa, Homo sapiens
  ENSP00000471092
  MOD_RES (1)..(1): Any amino acid
XGDPILDEEFQRLKTEVSHKRVVRNQEEKIKEFHPTFDPLINNTWLSRSRAQKRFQQVARKVMIQGRLFNMLSAVREMDKESILRKIGQAKQSIAQGEVWLQSTEMPRLIMPLSVNFP

SEQ ID NO: 26249 - protein, 399 aa, Homo sapiens
  ENSP00000413299
  MOD_RES (1)..(1): Any amino acid
XHPTFDPLINNTWLSRSRAQKRFQQVARKVMIQGRLFNMLSAVREMDKESILRKIGQAKQSIAQEANFFKFFLRRISQDDYTSRFSVSPKEVLPFAFPDCSPPQDSNELAPDGLGLVPIKSSEVQIKQSYSFFNLQVPQLYKIKRYQPFSVHKSSTSYRPQKLARALKQGAEDEVTTITALPKQDSTTQLSGKTSVLSMKPPEALAMSLDYDPLYVFNPNPGLFAVMHPLTYAETLIDYHLCSHPKYKFTKESRHGSSIPVTQKQFLHHTDIIPGIMHWKSFQSLVLSSLPDPSKMETTKSCDSFNSFMLPIDVPAILDALPEEDRLETVERELCEQNVEVMLTPEMIKVEFPMLNYKDIRKEKEVKDQAQPAEKAGEKLLEEMRNLRGKALNTYLILE

SEQ ID NO: 26250 - protein, 88 aa, Homo sapiens
  ENSP00000471998
  MOD_RES (1)..(1): Any amino acid
XFNLQVPQLYKIKRYQPFSVHKSSTSYRPQKLARALKQGAEDEVTTITALPKQDSTTQLSGKTSVLSMKPPEALAMSLDYDPLYVFTS

SEQ ID NO: 26251 - protein, 96 aa, Homo sapiens
  ENSP00000399793
  MOD_RES (1)..(1): Any amino acid
XSRHGSSIPVTQKQFLHHTDIIPGIMHWKSFQSLVLSSLPDPSKMETTKSCDSFNSFMLPIDVPAILDALPEEDRLETVERSTWICCCICDDRVGV

SEQ ID NO: 26252 - protein, 514 aa, Homo sapiens
  ENSP00000394274
  MOD_RES (1)..(1): Any amino acid
XWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKSQTSEAVRKSREDLDVCKEHYDNLLAEDKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 26253 - protein, 997 aa, Homo sapiens
  ENSP00000391364
  MOD_RES (1)..(1): Any amino acid
XPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 26254 - protein, 870 aa, Homo sapiens
  ENSP00000278064
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKVLF

SEQ ID NO: 26255 - protein, 412 aa, Homo sapiens
  ENSP00000358734
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVV

SEQ ID NO: 26256 - protein, 303 aa, Homo sapiens
  ENSP00000358733
MATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKVCWMVIS

SEQ ID NO: 26257 - protein, 1665 aa, Homo sapiens
  ENSP00000349568
MAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTEVAKDILQISTVSLLETDIVEVMVLSSLPEAGRSRLEMFTLPTLLPQVSTTFADERGRLKDEIIHKYLYELEHALSSAVLGFQSNQIYGFCSQVPYICSYLLPEEEHTGIYILKPYKKVQSRQYGPGLLYLSSHGLWLITIAKCGILCIRDVYTLETFAWCRSHSHQGHGIQSMRISMDGQNILVNGRDDGTLVYLKWKRFGGHLASEILDYYQKLLISLSSAMDKENHYLSTTPKVSVDLGSDSEHTKQKASTDLSQDELVLTDVKKEIPWIQQKSQEAIKKEVNLFSKKRKEIKQGIKSLSKTILNMMEENDKLENIAKLDQQEFGLDLEELERLHDESQEEVAKMIKDVEMHNLAKSYLAELIKEECWNSMAVKGRALKCFHIPCVVENFPMKARTVEELKELERVLQQKKIEAECLKLRKEIVEAQSGVKLIKQRHEEDDEEEEEEDKTVKYSNLPNYLLGSLSTDFGVDTSLLSSQLELHSREEKINQIILLKDIIYKVKTVFNNEFDAAYKQKEFEIARVKERNVRIREIILDLELEEAVWQPEFEDCEKPERTLVVQDEEITAHKHIKPWHKAKELIVNHEKEHWLLIQDASTRLRALMDMMGGVLEVKKEDILRMVIPQPAFMAKPDAVWTEEERKQFKDYEKKVKELNEERDKYRKSLEAELKKLQNSIQESTQAFDEHLKRLFERRVKAEMVTNQEELKISNLAFSLLLDEELSSREKFLNNYLTRKQHEKSQTSEAVRKSREDLDVCKEHYDNLLAEDKVMDRSFKKEFSEIPGHQVDILYKLFKRRPRISKQKTHSETTSVVPFGELPGSGKLNKDAFAQLMKAMDELDNISNMPEGLDPLVWNHFCMTRRAKVENEQKVKQKAADLLEMATFLQKRVEEEEKVQQEIERVFHELILLQEEKVRFQLNLTIQILLKQGQVELENFQLVLEYSDAILINKNIIEDLNSVIRTQGQKKVASMMESKDVHKRILQIEWEHKKMEMEREDLNQKAWDIQMLFFSRDRQKYLNEPNYEALISIQIGIMEQTIAVLDKMHKKNVENCKKLLKKLGKFSNQKDIANYALSCNLREELVAVSERKDICNAMGSKLTCEKIVKERYENMMQQQKLTNISKQQAEQISILQTEVERLRMKTFPALVQM

SEQ ID NO: 26258 - protein, 2715 aa, Homo sapiens
  ENSP00000357575
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKDPGKLIEMECLECESEALRLESKMKVYNRAAVEAQLDIIQRLDVALQRAVRLGDPRVIHVVCATQWNTCLPLLQHNLRHHLRKPLAGVADVLEKLDSLMTLLRCQVHMEMAQIEEDEDRLEPATEHLRKAARLDSLGLYRDRIQMASTRLRLCTTLYQAPERAEDKAIMAVEQAKKATPKDSVRKKRALLVNAGLALAPDAFQIVLDSENEAKVSTGKNRGRFTYLCAKAWHHTVSVDKAAGHLRRLGNENDKERIQIWAELAKVARKQGVWDVCRTASRFCLLYDNVKVKKLRLRRGKKKRGRDGSVQDTWSQPEVVLQRQVCPDLLRKFAEVGFIHAEATVHLLRSEGVELNDRAIPPEDLSQHPAGYVPEPPEVNAEWITYRTWIESLSRCAMNNWLRSAEIGQEIQEAWIVQNAVVYVLNHNHHLILAGRQKELVDALYHLLSIVKATGHSGDPVMLVTLCNTLARGLIISWIPVQAAEKSRKFMRPNAFHSPLDAGATSEIKTAVEVCEFALNLTNGSAPEETVPTGTRQQLIATWVKAKQLLQQQIGPRLGTEEQGTNEDVSSVTRVLVALEMYSCNGLGLMDFTVPSLAQLVKMASECNWSDPLVELQTLTRLTHFAHAARDHETTMACAHRALEMGIKYLKKFGPEESRLVAEMLCTATAIQGRSIMENLKGRKQLRLVAAKAFTESARFGGIAGSSALVMLAARHYWNAWLPLLSSAVYRKKAKGALKRLIGIINKTEARKQEKGKTLLLHQWPTADFQGGGTTEGYFLPGAEDDLALRAALYGLLFHSHADQDDWEGGLKVLDEAVQVLPRTAHRLLIFKHMVIVKAKLGQNFSMEIQKFKAESEDYLARMWHRLALNSPSVSGELACYNNAIQALQKPEMEWQKVEYLMEFGQWLHHRHFPLEDVVFHLRWAVEILLAMKPPGDVPEPQPTPDGEYVAVEMPPRSPVSEAEEAVSLEQLRSVRQLEALARVHILLALVLSPGAEGYEDCCLAAYAFFRHIWQVSLMTAGKSVLENRPLAATSSHLLLPKKEKENERSKEKEKERSKEKENERSKEKDKEKGKEEKVKEPKQSQSPAPIKQLEDLPMSIEEWASYSCPEEVLSVLKQDRSDSTVNPSSIQKPTYSLYFLDHLVKALQKMCLHELTVPVLQLGVLISDSVVGSKGLSDLYHLRLAHACSELKLREAAARHEEAVGQVCVSELEQASCRKEIALKKEKNKEPLLEESLPALNEQTLPVQPGEIKPLDAKDKILKMNGETGRDLDGTSFPHLWMLKAEVLLEMNLYQPARLLLSEAYLAFQELDEPCAEAQCLLLLAQLANKEKNYGQAKKMIAQAQHLGGSEEFWYNSTLTLAEALLSMEHSGREATVCHIFQKLINAFKILKKERPNRLPLLEFMITDLEARCLSLRVRVAQHSAVTEPTECSLLLKEMDDGLLEIERKFIDCGCKENCVDVKLERAKIKRLRAQNEKDEEQKTAYYLEAYGLAQGAVAEEEGRLHSIQGLYGLAQGAMAEEEGRLHSVQGLLSLQDLQNVNTPLMRKLARLKLGLVEMALDMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPATTCQFLALSQSCSASETMRDVLLAATANTSSSQLAALLQLQHQLRCQDRTTTSLGARVEQRLAAVSKAWQNLCVTEQHFNLLNEMPPTFWILFLHLSGDRSRLYGAAYEKPKFITAAKGKVQAVGGSCKVMRLAISPTAFSHLLACAQQFRKQTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVADRHLLELPLEGLSVFDEGTISSVSREFSLQMLWNRLHKEETEGGVKKEGRSRDPKKRSLAKKGRKGSIPRTIPPDCIIVDSDNFKFVVDPYEEAQGPEMLTPVSITQDILERFQDTFTSRWAGHLGSKHFPSQAQWEQALGSCSGFFFYGMESFLSHILVERLVAMNLQECQVAVLLDLARSYQSLKRHMESVEHRRSVGRWEANWRNSASPSEDEWRRGGEPRRGFSDLEGQAAAAPKLRAPSHHAQLGPVWAAAPSHRVVQAWTCLPSAAGAPALASALGSAPLPTHPHLPAPIPSSQLALPFLGLSPALGAASARDPPPATSRKAAAWTSSSACLCAPWGLRRGWSCVSSRGQDKGGLPLAALVLSCLDQKTIQTVSLFLI

SEQ ID NO: 26259 - protein, 144 aa, Homo sapiens
  ENSP00000491877
  MOD_RES (1)..(1): Any amino acid
XVAMNLQECQVAVLLDLARSYQSLKRHMESVEHRSASQLSLEEPVEAAILLSLVGVKSILANQWPTLLQDNALRASVLWENLLAVGKPIGETVRLLQKMSGDEAVNQDEASQTLKDKLLLLQSSELLPTTLNLVLYGLPHQAIG

SEQ ID NO: 26260 - protein, 153 aa, Homo sapiens
  ENSP00000417039
  MOD_RES (1)..(1): Any amino acid
XTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVADRHLLELPLEGLSVFDEGTISSVSREFSLQMLWNRLHKEETDSEKHEGARGRP

SEQ ID NO: 26261 - protein, 405 aa, Homo sapiens
  ENSP00000357574
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKVSGFMTLLPGDEALLTVQLDKRQRKEEQFTRPRPPGLRSVVGTLPSFLPVFCTVAVRWCLQFYTCPFLFTFLVATGPQHHSCF

SEQ ID NO: 26262 - protein, 514 aa, Homo sapiens
  ENSP00000381553
MYSQRFGTVQREVKGPTPKVVIVRSKPPKGQGAEHHLERIRRSHQKHNAILASIKSSERDRLKAEWDQHNDCKILDSLVRARIKDAVQGFIINIEERRNKLRELLALEENEYFTEMQLKKETIEEKKDRMREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVESNNAQIKHENEQDMLKKQKAKQETRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFARRQRLAQEYRKQLQMQIAYQQQSQEAEKEEKRREFEAGVAANKMCLDKVQEVLSTHQVLPQNIHPMRKACPSKLPP

SEQ ID NO: 26263 - protein, 498 aa, Homo sapiens
  ENSP00000409527
QEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKELEELTEAEDALSEANALNNYNAEVWAYLALVCLKVGRQLEAEQAYKYMIKLKLKDEALLAEIHTLQETVGFGNPSF

SEQ ID NO: 26264 - protein, 361 aa, Homo sapiens
  ENSP00000343650
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLNGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 26265 - protein, 590 aa, Homo sapiens
  ENSP00000347781
MFGKQVAKLESDMDSETLEEQKCQLSYELNCSGKYFAFKEQLKHAVVKIVRDKYLKTTSFESQEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 26266 - protein, 1121 aa, Homo sapiens
  ENSP00000310829
MEQVPSAGRLVQITVTEGYDLKGFKGDTPVTFIRAEFNQVVLGDSAKITVSPEGSAKYNFTSSFEFNPEGGITSDDLAHKPVFLTVTEVLPKEKKQKEEKTLILGQAVVDLLPLLEGQSSFQTTVPLHPVQGSPLETPRSSAKQCSLEVKVLVAEPLLTTAQISGGNLLKVTLEAAYSVPESFIPTGPGQNYMVGLQVPSLGEKDYPILFKNGTLKLGGEREPVPRPKKWPIANILAPGANNIPDAFIVGGPYEEEEGELNHPEDSEFRNQAECIKKRIIWDLESRCYLDPSAVVSFQKRIADCRLWPVEITRVPLVTIPKGKAGKTEKTDEEAQLSFHGVAYVNMVPLLYPGVKRIRGAFHVYPYLDSVVHEKTKCLLSLFRDIGHHLIHNNKIGGINSLLSKQAVSKNLKEDKPVKEKDIDGRPRPGDVQAPSIKSQSSDTPLEGEPPLSHNPEGQQYVEAGTYIVLEIQLDKALVPKRMPEELARRVKEMIPPRPPLTRRTGGAQKAMSDYHIQIKNISRAILDEYYRMFGKQVAKLESDMDSETLEEQKCQLSYELNCSGKYFAFKEQLKHAVVKIVRDKYLKTTSFESQEELQTFISELYVFLVDQMHVALNQTMPDDVQGTVATIYTSSEQLQLFAFEAEVNENFEMAAAYYKERLVREPQNLDHWLDYGAFCLLTEDNIKAQECFQKALSLNQSHIHSLLLCGVLAVLLENYEQAEIFFEDATCLEPTNVVAWTLLGLYYEIQNNDIRMEMAFHEASKQLQARMLQAQVTKQKSTGVEDTEERGKRESSLGPWGITNGSATAIKVEAPAGPGAALSILDKFLEESSKLQSDSQEPILTTQTWDPSISQKPSNTFIKEIPTKKEASKCQDSSALLHPGLHYGVSQTTTIFMETIHFLMKVKAVQYVHRVLAHELLCPQGGPSCEYYLVLAQTHILKKNFAKAEEYLQQAAQMDYLNPNVWGLKGHLYFLSGNHSEAKACYERTISFVVDASEMHFIFLRLGLIYLEEKEYEKAKKTYMQACKRSPSCLTWLGLGIACYRLEELTEAEDALSEANALNNYNAEVWAYLALVCLKVGRQLEAEQAYKYMIKLKLKDEALLAEIHTLQETVGFGNPSF

SEQ ID NO: 26267 - protein, 179 aa, Homo sapiens [sequence omitted]

SEQ ID NO: 26268 - protein, 1584 aa, Homo sapiens
  ENSP00000417061
MEDDGSLLPEDELLADALLLEDERDELEDPEFDIKCLLQEAEDDVDPGHSSSVKELDTDADKLKKKTAEDRTQAFHLRQNLSALDKMHEEQELFTEKMRGELRACRQRRDLIDKQQEAVAAEIATEEEAGNMAAVGRLQAVSRRLFAELENERDLQSRTEAVLKESENTMWHIEIQEGRLEAFRTADREEVEATGRRLQVRAAEQLCREQEALGKVERNRLLRIRKSLNTQKELGLRHQKLLEDARKNHKVAVRFLKASLGRIREQEKKEEMECHEYMRRRMDAVVALKGSISANRDTLRKFQAWDRAKAELAEQRVQAEKKAILAQGRDAFRHLVHQRRRQELEAQKRAFEEEQKLRKQEIISRILKEEAEEEKRKKQHPPTSARHRLTLRDKTWNYISDFCKKTTVPTNTYTLDYEAAAGPGPSRLLEVVSSELIQGDPGASSEEETLAEPEISGLWNEDYKPYQVPKEDVDRKPVGGTKMDKDILERTVERLRSRVVHKQVVWGREFQGRPFNSKPELLHFQDFDIGKVYKKKITLVNTTYTINYCKLVGVEEHLRDFIHVDFDPPGPLSAGMSCEVLVTFKPMINKDLEGNISFLAQTGEFSVPLKCSTKKCSLSLDKELIDFGSYVVGETTSRTITLTNVGGLGTTFKFLPASEPCEMDDSQSALKLSSLLTYEDKSLYDKAATSFSEQQLEGTESSQADMQSRKELEKLDKEQEEEQPAEPERLTTVIPPSEEQTEITLGEVTEGEIGPFSSIKVPIVFTPVVPGDVQARFKVTFKNPQCPTLHFRVVGVAIDVPVWVPKPSVDLKICMYDRLYQDSVLVHTRSKAALRLKFEVCKELRAHLELLPKTGYIQAQSSYSVQLKFLPRHSLPEDAGRYFDKETRVLEAPMTIWVADQNKPVGFTVHAIVTTSDLELSPSEVDFGYCTIYEAIRTEISLHNHSLLPQEFGFVRLPKFVDVQPNDGFGTILPLETLQFCVIFQPTKAEEHRFQLTCKSEINRCFKLSCRAVGVHPPLELSHYQIKFAATALYDTSVATVYVINSHLSMSSPTHSKPRIGSEDASPMGPTSFEFLLPPDSPITISPSVGTVWPGKRCLVQVAFRPVLPEKLIRQEALPLLNKEMETKSFRKNMAPQRKDLHGLSFSVLRAQNRDKLFKVSVPHVLEMRKRELRPSSDEYQAARATLLRAFQAKFDTFVVPCVVASGDIKDRKGSEPLSFSPHNTLYLELWCPTVAPSVVVTSHKGKTIFNFGDVAVGHRSIKKISIQNVSPEDLALDFSLLNPNGPFVLLNHSSLLRAGGTQVLVLSFSPHESILAQETLDIITKRGTLTLTLMGTGVASMITCSIEGSVLNMGYVIAGESVSSGFKLQNNSLLPIKFSMHLDSLSSTRGRGQQQLPQFLSSPSQRTEVVGTQNLNGQSVFSVAPVKGVMDPGKTQDFTVTFSPDHESLYFSDKLQVVLFEKKISHQILLKGAACQHMMFVEGGDPLDVPVESLTAIPVFDPRHREEAEELRPILVTLDYIQFDTDTPAPPATRELQVGCIRTTQPSPKKPDHPLMVSALLQLRGDVKETYKVIFVAQVLTGP

SEQ ID NO: 26269 - protein, 92 aa, Homo sapiens
  ENSP00000367853
EDELLADALLLEDERDELEDPEFDIKCLLQEAEDDVDPGHSSSVKELDTDADKLKKKTAEDRTQAFHLRQNLSALDKMHEEQELFTEKMSVS

SEQ ID NO: 26270 - protein, 170 aa, Homo sapiens
  ENSP00000425532
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTI

SEQ ID NO: 26271 - protein, 170 aa, Homo sapiens; identical to SEQ ID NO: 26270
  ENSP00000422299

SEQ ID NO: 26272 - protein, 291 aa, Homo sapiens
  ENSP00000410836
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQ

SEQ ID NO: 26273 - protein, 1203 aa, Homo sapiens
  ENSP00000271636
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKELQNMKRLLDQGEDLRHGLETQVMELQNKLKHVQGPEPAKEVLLKDLLETRELLEEVLEGKQRVEEQLRLRERELTALKGALKEEVASRDQEVEHVRQQYQRDTEQLRRSMQDATQDHAVLEAERQKMSALVRGLQRELEETSEETGHWQSMFQKNKEDLRATKQELLQLRMEKEEMEEELGEKIEVLQRELEQARASAGDTRQVEVLKKELLRTQEELKELQAERQSQEVAGRHRDRELEKQLAVLRVEADRGRELEEQNLQLQKTLQQLRQDCEEASKAKMVAEAEATVLGQRRAAVETTLRETQEENDEFRRRILGLEQQLKETRGLVDGGEAVEARLRDKLQRLEAEKQQLEEALNASQEEEGSLAAAKRALEARLEEAQRGLARLGQEQQTLNRALEEEGKQREVLRRGKAELEEQKRLLDRTVDRLNKELEKIGEDSKQALQQLQAQLEDYKEKARREVADAQRQAKDWASEAEKTSGGLSRLQDEIQRLRQALQASQAERDTARLDKELLAQRLQGLEQEAENKKRSQDDRARQLKGLEEKVSRLETELDEEKNTVELLTDRVNRGRDQVDQLRTELMQERSARQDLECDKISLERQNKDLKTRLASSEGFQKPSASLSQLESQNQLLQERLQAEEREKTVLQSTNRKLERKVKELSIQIEDERQHVNDQKDQLSLRVKALKRQVDEAEEEIERLDGLRKKAQREVEEQHEVNEQLQARIKSLEKDSWRKASRSAAESALKNEGLSSDEEFDSVYDPSSIASLLTESNLQTSSC

SEQ ID NO: 26274 - protein, 131 aa, Homo sapiens
  ENSP00000390686
  MOD_RES (1)..(1): Any amino acid
XQDPTMLQFKSTPDLLRDQQEAAPPGSVDHMKATIYGILREGSSESETSVRRKVSLVLEKMQPLVAVAGQGELTRKVEELQRKLDEEVKKRQKLEPSQVGLERQLEEKTEECSRLQELLERRKGEAQQSNK

SEQ ID NO: 26275 - protein, 1302 aa, Homo sapiens
  ENSP00000281282
MELYFGEYQHVQQEYGVHLRLASDDTQKSRSSQNSKAGSYGVSIRVQGIDGHPYIVLNNTERCLAGTSFSENGPPFPPPVINNLPLHSSNGSVPKENSEELQLPENPYAQPSPIRNLKQPLLHEGKNGVLDRKDGSVKPSHLLNFQRHPELLQPYDPEKNELNLQNHQPSESNWLKTLTEEGINNKKPWTCFPKPSNSQPTSPSLEDPAKSGVTAIRLCSSVVIEDPKKQTSVCVNVQSCTKERVGEEALFTSGRPLTAHSPHAHPETKKTRPDVLPFRRQDSAGPVLDGARSRRSSSSSTTPTSANSLYRFLLDDQECAIHADNVNRHENRRYIPFLPGTGRDIDTGSIPGVDQLIEKFDQKPGLQRRGRSGKRNRINTDDRKRSRSVDSAFPFGLQGNSEYLIEFSRNLGKSSEHLLRPSQVCPQRPLSQERRGKQSVGRTFAKLQGAAHGASCAHSRPPQPNIDGKVLETEGSQESTVIRAPSLGAQSKKEEEVKTATATLMLQNRATATSPDSGAKKISVKTFPSASNTQATPDLLKGQQELTQQTNEETAKQILYNYLKEGSTDNDDATKRKVNLVFEKIQTLKSRAAGSAQGNNQACNSTSEVKDLLEQKSKLTIEVAELQRQLQLEVKNQQNIKEERERMRANLEELRSQHNEKVEENSTLQQRLEESEGELRKNLEELFQVKMEREQHQTEIRDLQDQLSEMHDELDSAKRSEDREKGALIEELLQAKQDLQDLLIAKEEQEDLLRKRERELTALKGALKEEVSSHDQEMDKLKEQYDAELQALRESVEEATKNVEVLASRSNTSEQDQAGTEMRVKLLQEENEKLQGRSEELERRVAQLQRQIEDLKGDEAKAKETLKKYEGEIRQLEEALVHARKEEKEAVSARRALENELEAAQGNLSQTTQEQKQLSEKLKEESEQKEQLRRLKNEMENERWHLGKTIEKLQKEMADIVEASRTSTLELQNQLDEYKEKNRRELAEMQRQLKEKTLEAEKSRLTAMKMQDEMRLMEEELRDYQRAQDEALTKRQLLEQTLKDLEYELEAKSHLKDDRSRLVKQMEDKVSQLEMELEEERNNSDLLSERISRSREQMEQLRNELLQERAARQDLECDKISLERQNKDLKSRIIHLEGSYRSSKEGLVVQMEARIAELEDRLESEERDRANLQLSNRRLERKVKELVMQVDDEHLSLTDQKDQLSLRLKAMKRQVEEAEEEIDRLESSKKKLQRELEEQMDMNEHLQGQLNSMKKDLRLKKLPSKVLDDMDDDDDLSTDGGSLYEAPVSYTFSKDSTVASQI

SEQ ID NO: 26276 - protein, 219 aa, Homo sapiens
  ENSP00000395466
MGGAQLELPSGARPGVCVRRSFRAHAGDQPRRPPGPIPVPGTMKQESAAPNTPPTSQSPTPSAQFPRNDGDPQALWIFGYGSLVWRPDFAYSDSRVGFVRGYSRRFWQGDTFHRGSDKMPGRVVTLLEDHEGCTWGVAYQVQGEQNPGYLGPAPEEAIATQILACRGFSGHNLEYLLRLADFMQLCGPQAQDEHLAAIVDAVGTMLPCFCPTEQALALV

SEQ ID NO: 26277 - protein, 264 aa, Homo sapiens
  ENSP00000398105
MGGAQLELPSGARPGVCVRRSFRAHAGDQPRRPPGPIPVPGTMKQESAAPNTPPTSQSPTPSAQFPRNDGDPQALWIFGYGSLVWRPDFAYSDSRVGFVRGYSRRFWQGDTFHRGSDKMPGRVVTLLEDHEGCTWGVAYQVQGEQVSKALKYLNVREAVLGGYDTKEVTFYPQDAPDQPLKALAYVATPQNPGYLGPAPEEAIATQILACRGFSGHNLEYLLRLADFMQLCGPQAQDEHLAAIVDAVGTMLPCFCPTEQALALV

SEQ ID NO: 26278 - protein, 222 aa, Homo sapiens
  ENSP00000481816
MKQESAAPNTPPTSQSPTPSAQFPRNDGDPQALWIFGYGSLVWRPDFAYSDSRVGFVRGYSRRFWQGDTFHRGSDKMPGRVVTLLEDHEGCTWGVAYQVQGEQVSKALKYLNVREAVLGGYDTKEVTFYPQDAPDQPLKALAYVATPQNPGYLGPAPEEAIATQILACRGFSGHNLEYLLRLADFMQLCGPQAQDEHLAAIVDAVGTMLPCFCPTEQALALV

SEQ ID NO: 26279 - protein, 37 aa, Homo sapiens
  ENSP00000452707
MQLCGPQAQDEHLAAIVDAVGTMLPCFCPTEQALALV

SEQ ID NO: 26280 - protein, 264 aa, Homo sapiens; identical to SEQ ID NO: 26277
  ENSP00000484644

SEQ ID NO: 26281 - protein, 2997 aa, Homo sapiens
  ENSP00000392028
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKEPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLEHKVLLTGTPLQNTVEELFSLLHFLEPSRFPSETTFMQEFGDLKTEEQVQKLQAILKPMMLRRLKEDVEKNLAPKEETIIEVELTNIQKKYYRAILEKNFTFLSKGGGQANVPNLLNTMMELRKCCNHPYLINGAEEKILEEFKETHNAESPDFQLQAMIQAAGKLVLIDKLLPKLKAGGHRVLIFSQMVRCLDILEDYLIQRRYPYERIDGRVRGNLRQAAIDRFSKPDSDRFVFLLCTRAGGLGINLTAADTCIIFDSDWNPQNDLQAQARCHRIGQSKSVKIYRLITRNSYEREMFDKASLKLGLDKAVLQSMSGRENATNGVQQLSKKEIEDLLRKGAYGALMDEEDEGSKFCEEDIDQILLRRTHTITIESEGKGSTFAKASFVASGNRTDISLDDPNFWQKWAKKAELDIDALNGRNNLVIDTPRVRKQTRLYSAVKEDELMEFSDLESDSEEKPCAKPRRPQDKSQGYARSECFRVEKNLLVYGWGRWTDILSHGRYKRQLTEQDVETICRTILVYCLNHYKGDENIKSFIWDLITPTADGQTRALVNHSGLSAPVPRGRKGKKVKAQSTQPVVQDADWLASCNPDALFQEDSYKKHLKHHCNKVLLRVRMLYYLRQEVIGDQADKILEGADSSEADVWIPEPFHAEVPADWWDKEADKSLLIGVFKHGYEKYNSMRADPALCFLERVGMPDAKAIAAEQRGTDMLADGGDGGEFDREDEDPEYKPTRTPFKDEIDEFANSPSEDKEESMEIHATGKHSESNAELGQLYWPNTSTLTTRLRRLITAYQRSYKRQQMRQEALMKTDRRRRRPREEVRALEAEREAIISEKRQKWTRREEADFYRVVSTFGVIFDPVKQQFDWNQFRAFARLDKKSDESLEKYFSCFVAMCRRVCRMPVKPDDEPPDLSSIIEPITEERASRTLYRIELLRKIREQVLHHPQLGERLKLCQPSLDLPEWWECGRHDRDLLVGAAKHGVSRTDYHILNDPELSFLDAHKNFAQNRGAGNTSSLNPLAVGFVQTPPVISSAHIQDERVLEQAEGKVEEPENPAAKEKCEGKEEEEETDGSGKESKQECEAEASSVKNELKGVEVGADTGSKSISEKGSEEDEEEKLEDDDKSEESSQPEAGAVSRGKNFDEESNASMSTARDETRDGFYMEDGDPSVAQLLHERTFAFSFWPKDRVMINRLDNICEAVLKGKWPVNRRQMFDFQGLIPGYTPTTVDSPLQKRSFAELSMVGQASISGSEDITTSPQLSKEDALNLSVPRQRRRRRRKIEIEAERAAKRRNLMEMVAQLRESQVVSENGQEKVVDLSKASREATSSTSNFSSLSSKFILPNVSTPVSDAFKTQMELLQAGLSRTPTRHLLNGSLVDGEPPMKRRRGRRKNVEGLDLLFMSHKRTSLSAEDAEVTKAFEEDIETPPTRNIPSPGQLDPDTRIPVINLEDGTRLVGEDAPKNKDLVEWLKLHPTYTVDMPSYVPKNADVLFSSFQKPKQKRHRCRNPNKLDINTLTGEERVPVVNKRNGKKMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 26282 - protein, 32 aa, Homo sapiens
  ENSP00000436492
MADPGMMSLFGEDGNIFSEGLEGLGECGYPEN

SEQ ID NO: 26283 - protein, 948 aa, Homo sapiens
  ENSP00000437061
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQKPKQKRHRCRNPNKLDINTLTGEERVPVVNKRNGKKMGGAMAPPMKDLPRWLEENPEFAVAPDWTDIVKQSGFVPESMFDRLLTGPVVRGEGASRRGRRPKSEIARAAAAAAAVASTSGINPLLVNSLFAGMDLTSLQNLQNLQSLQLAGLMGFPPGLATAATAGGDAKNPAAVLPLMLPGMAGLPNVFGLGGLLNNPLSAATGNTTTASSQGEPEDSTSKGEEKGNENEDENKDSEKSTDAVSAADSANGSVGAATAPAGLPSNPLAFNPFLLSTMAPGLFYPSMFLPPGLGGLTLPGFPALAGLQNAVGSSEEKAADKAEGGPFKDGETLEGSDAEESLDKTAESSLLEDEIAQGEELDSLDGGDEIENNENDE

SEQ ID NO: 26284 - protein, 1138 aa, Homo sapiens
  ENSP00000436027
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKEPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSSRSVKKQKESGEEVEIEEFYVKYKNFSYLHCQWASIEDLEKDKRIQQKIKRFKAKQGQNKFLSEIEDELFNPDYVEVDRIMDFARSTDDRGEPVTHYLVKWCSLPYEDSTWERRQDIDQAKIEEFEKLMSREPETERVERPPADDWKKSESSREYKNNNKLREYQLEGVNWLLFNWYNMRNCILADEMGLGKTIQSITFLYEIYLKGIHGPFLVIAPLSTIPNWEREFRTWTELNVVVYHGSQASRRTIQLYEMYFKDPQGRVIKGSYKFHAIITTFEMILTDCPELRNIPWRCVVIDEAHRLKNRNCKLLEGLKMMDLVSDHIGDCTEPE

SEQ ID NO: 26285 - protein, 19 aa, Homo sapiens
  ENSP00000432627
  MOD_RES (1)..(1): Any amino acid
XSSMWGPRAVQACPRHQGN

SEQ ID NO: 26286 - protein, 39 aa, Homo sapiens
  ENSP00000433336
HQPWAQLHPSPQNTPQKVPVHQHSPSEPFLEKPVPDMTQ

SEQ ID NO: 26287 - protein, 594 aa, Homo sapiens
  ENSP00000319851
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRAYASKEVILSGGAINSPQLLMLSGIGNADDLKKLGIPVVCHLPGVGQNLQDHLEIYIQQACTRPITLHSAQKPLRKVCIGLEWLWKFTGEGATAHLETGGFIRSQPGVPHPDIQFHFLPSQVIDHGRVPTQQEAYQVHVGPMRGTSVGWLKLRSANPQDHPVIQPNYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 26288 - protein, 155 aa, Homo sapiens
  ENSP00000418273
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGRVWGGSSSLNAMVYVRGHAEDYERWQRQGA

SEQ ID NO: 26289 - protein, 126 aa, Homo sapiens
  ENSP00000419863
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGR

SEQ ID NO: 26290 - protein, 677 aa, Homo sapiens
  ENSP00000368244
MQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 26291 - protein, 289 aa, Homo sapiens
  ENSP00000416643
MPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQE

SEQ ID NO: 26292 - protein, 69 aa, Homo sapiens
  ENSP00000433879
LKDHRPRMVWDSQASEHFFEYKKSRSGRHVVFYPTLKSLQVRLELARELGVGVSIWELGQGLDYFYDLL

SEQ ID NO: 26293 - protein, 108 aa, Homo sapiens
  ENSP00000431169
  MOD_RES (1)..(1): Any amino acid
XPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 26294 - protein, 393 aa, Homo sapiens
  ENSP00000325055
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 26295 - protein, 84 aa, Homo sapiens
  ENSP00000431356
  MOD_RES (1)..(1): Any amino acid
XDAREPVVGARYIQTLKDHRPRMVWDSQASEHFFEYKKSRSGRHVVFYPTLKSLQVRLELARELGVGVSIWELGQGLDYFYDLL

SEQ ID NO: 26296 - protein, 362 aa, Homo sapiens
  ENSP00000416034
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 26297 - protein, 418 aa, Homo sapiens
  ENSP00000435503
MRTLFNLLWLALACSPVHTTLSKSDAKKAASKTLLEKVKFCSCCPGWSAMARSWLTATSATQSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 26298 - protein, 393 aa, Homo sapiens; identical to SEQ ID NO: 26294
  ENSP00000388156

SEQ ID NO: 26299 - protein, 72 aa, Homo sapiens
  ENSP00000435336
  MOD_RES (1)..(1): Any amino acid
XQLGMFTHKEFEQLAPVLDGFSLMTYDYSTAHQPGPNAPLSWVRACVQVLDPKSKWRSKILLGLNFYGTSRH

SEQ ID NO: 26300 - protein, 224 aa, Homo sapiens
  ENSP00000434651
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGAR

SEQ ID NO: 26301 - protein, 162 aa, Homo sapiens
  ENSP00000432697
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGSHPSCLTVLAPQAEKSGGCELSGSMPRACT

SEQ ID NO: 26302 - protein, 84 aa, Homo sapiens
  ENSP00000432431
MRTLFNLLWLALACSPVHTTLSKSDAKKAASKTLLEKAGAQWRDLGSPQPLPPRFKRFSCFSLPSSWDYRVSFQISRCKTGVWW

SEQ ID NO: 26303 - protein, 131 aa, Homo sapiens
  ENSP00000436017
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQ

SEQ ID NO: 26304 - protein, 119 aa, Homo sapiens
  ENSP00000435731
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGRE

SEQ ID NO: 26305 - protein, 115 aa, Homo sapiens
  ENSP00000436752
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKR

SEQ ID NO: 26306 - protein, 84 aa, Homo sapiens
  ENSP00000433570
MRTLFNLLWLALACSPVHTTLSKSDAKKAASKTLLEKSQFSDKPVQDRGLVVTDLKAESVVLEHRSYCSAKARDRHFAGDVLGY

SEQ ID NO: 26307 - protein, 38 aa, Homo sapiens
  ENSP00000435607
MRTLFNLLWLALACSPVHTTLSKSDAKKAASKTLLEKV

SEQ ID NO: 26308 - protein, 26 aa, Homo sapiens
  ENSP00000431766
MRTLFNLLWLALACSPVHTTLSKSDA

SEQ ID NO: 26309 - protein, 418 aa, Homo sapiens; identical to SEQ ID NO: 26297
  ENSP00000398722

SEQ ID NO: 26310 - protein, 393 aa, Homo sapiens; identical to SEQ ID NO: 26294
  ENSP00000391255

SEQ ID NO: 26311 - protein, 1224 aa, Homo sapiens
  ENSP00000256509
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 26312 - protein, 1208 aa, Homo sapiens
  ENSP00000380628
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 26313 - protein, 65 aa, Homo sapiens
  ENSP00000403311
MEPLLLGRGLIVYLMFLLLKFSKAIEIPSSVQQVPTIIKQSKVQVAFPFDEYFQIECEAKGNPEP

SEQ ID NO: 26314 - protein, 96 aa, Homo sapiens
  ENSP00000413628
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPN

SEQ ID NO: 26315 - protein, 93 aa, Homo sapiens
  ENSP00000413109
MPPAWSGESMDRGVVGLGSTKTQRGARAPPPQTAEGREGAPGAVVAMAPGSGARGAGDAGRGWSLLPLCASLFLSLFFFFWSVSVRGEAARRK

SEQ ID NO: 26316 - protein, 181 aa, Homo sapiens
  ENSP00000397445
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVY

SEQ ID NO: 26317 - protein, 84 aa, Homo sapiens
  ENSP00000390440
MEPLLLGRGLIVYLMFLLLKFSKAIEIPSSVQQVPTIIKQSKVQVAFPFDEYFQIECEAKGNPEPTFSWTKDGNPFYFTDHRII

SEQ ID NO: 26318 - protein, 358 aa, Homo sapiens
  ENSP00000395239
  MOD_RES (1)..(1): Any amino acid
XSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 26319 - protein, 1171 aa, Homo sapiens
  ENSP00000483512
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSLKHANDSSSSTEIGSKANSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGKYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 26320 - protein, 37 aa, Homo sapiens
  ENSP00000462650
MTQTHRAKSASSCPNLLVPETWPHQVSASHAGRSKQP

SEQ ID NO: 26321 - protein, 187 aa, Homo sapiens
  ENSP00000409843
MTQTHRAKSASSCPNLLVPETWPHQVSASHAGRSKQPQGGILKINEEHRRGAIQDLLASPGFTFGKRVVFDSHCLKRQHTFADGLHSSCTSNAEEYQPPIWKSYLYQLQQEAPRPKRIICPREVENRPKYYGREFHGIISREQADELLGGVEGAYILRESQRQPGCYTLALRFGNQTLNYRLFHDGK

SEQ ID NO: 26322 - protein, 136 aa, Homo sapiens
  ENSP00000441183
  MOD_RES (1)..(1): Any amino acid
XRAKSASSCPNLLVPETWPHQVSASHAGRSKQPQGGILKINEEHRRGAIQMLKNTSLLYGNHTYISYSKRHLVPRESFVLGRWKTDQNIMEESFMGSSLGSRRMSFLEAWRVPTSLEKASGNQDATRWLSGLETRP

SEQ ID NO: 26323 - protein, 468 aa, Homo sapiens
  ENSP00000222792
MAASSNSSLSGSSVSSDAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATLLREKVSRRLSRSKNEPRKTNVTHEEHTAVEKISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 26324 - protein, 174 aa, Homo sapiens
  ENSP00000386968
MAASSNSSLSGSSVSSVYSEPRSPRELPKYAEEYQPPIWKSYLYQLQQEAPRPKRIICPREVENRPKYYGREFHGIISREQADELLGGVEGAYILRESQRQPGCYTLALRFGNQTLNYRLFHDGKHFVGEKRFESIHDLVTDGLITLYIETKAAEYISKMTTNPIYEHIGYATL

SEQ ID NO: 26325 - protein, 180 aa, Homo sapiens
  ENSP00000396867
NPIYEHIGYATLLREKVSRRLSRSKNEPRKTNVTHEEHTAVEKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLY

SEQ ID NO: 26326 - protein, 332 aa, Homo sapiens
  ENSP00000486515
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 26327 - protein, 91 aa, Homo sapiens
  ENSP00000398326
  MOD_RES (1)..(1): Any amino acid
XDVKMAFDRDGEKADISANVYPDINIITGALKLYFRDLPIPVITYDTYSKFIDAAKISNADERLEAVHEVLMLLPPAHYETLRYLMIHLKK

SEQ ID NO: 26328 - protein, 197 aa, Homo sapiens
  ENSP00000387425
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEARGLKSEGLYRVSGFTEHIEDVKMAFDRGLL

SEQ ID NO: 26329 - protein, 274 aa, Homo sapiens
  ENSP00000394284
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSGLKSEGLYRVSGFTEHIEDVKMAFDRDGEKADISANVYPDINIITGALKLYFRDLPIPVITYDTYSKFIDAAKISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 26330 - protein, 228 aa, Homo sapiens
  ENSP00000406337
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSGLKSEGLYRVSGFTEHIEDVKMAFDREISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 26331 - protein, 260 aa, Homo sapiens
  ENSP00000386849
MFSEELWLENEKKCAVVRKSKQGRKRQELLAVAFGVKVGVKGGFLWPPLKLFACSQISSLVRRAALTHNDNHFNYEKTHNFKVHTFRGPHWCEYCANFMWGLIAQGVRCSDCGLNVHKQCSKHVPNDCQPDLKRIKKVYCCDLTTLVKAHNTQRPMVVDICIREIEAREISNADERLEAVHEVLMLLPPAHYETLRYLMIHLKKVTMNEKDNFMNAENLGIVFGPTLMRPPEDSTLTTLHDMRYQKLIVQILIENEDVLF

SEQ ID NO: 26332 - protein, 216 aa, Homo sapiens [sequence omitted]

SEQ ID NO: 26333 - protein, 232 aa, Homo sapiens
  ENSP00000382993
MAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 26334 - protein, 236 aa, Homo sapiens
  ENSP00000382996
MAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAVKEEQKLVQTSLHCGFQRVPEKKVAWKYNNSLTWFQNFVILDLYKEWHQNNSLEWLEITKDLQDEL

SEQ ID NO: 26335 - protein, 236 aa, Homo sapiens; identical to SEQ ID NO: 26334
  ENSP00000383001

SEQ ID NO: 26336 - protein, 232 aa, Homo sapiens; identical to SEQ ID NO: 26333
  ENSP00000382992

SEQ ID NO: 26337 - protein, 273 aa, Homo sapiens
  ENSP00000299295
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 26338 - protein, 254 aa, Homo sapiens
  ENSP00000443566
MTAGSAHSQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 26339 - protein, 236 aa, Homo sapiens; identical to SEQ ID NO: 26334
  ENSP00000339975

SEQ ID NO: 26340 - protein, 332 aa, Homo sapiens
  ENSP00000319255
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKTYQGLESLEEVCVYHSGVPIFHEGMKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 26341 - protein, 144 aa, Homo sapiens
  ENSP00000433719
MKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 26342 - protein, 313 aa, Homo sapiens
  ENSP00000401080
MALLCYNRGCGQRFDPETNSDDACTYHPGVPVFHDALKGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKTYQGLESLEEVCVYHSGVPIFHEGMKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDATTD

SEQ ID NO: 26343 - protein, 144 aa, Homo sapiens; identical to SEQ ID NO: 26341
  ENSP00000436632

SEQ ID NO: 26344 - protein, 184 aa, Homo sapiens
  ENSP00000436945
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKSLHLQQQWGPDLPDKPWIYI

SEQ ID NO: 26345 - protein, 120 aa, Homo sapiens
  ENSP00000434040
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPRFQNSPAQMNQ

SEQ ID NO: 26346 - protein, 116 aa, Homo sapiens
  ENSP00000431929
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPRSSSCYT

SEQ ID NO: 26347 - protein, 39 aa, Homo sapiens
  ENSP00000433440
MALLCYNRGCGQRFDPETNSDDACTYHPGVPVFHDALKS

SEQ ID NO: 26348 - protein, 117 aa, Homo sapiens
  ENSP00000432019
MALLCYNRGCGQRFDPETNSDGKRNAPPALPPLHLISRGGPLGRRVSADLLQPSSRGPRSMPLLGLPWLPAQPAGRPSVAPRSLGERPAPAPDCPLPLRRETLPWIHVFPPSSPHSF

SEQ ID NO: 26349 - protein, 86 aa, Homo sapiens
  ENSP00000348930
MPSLPAPPAPLLLLGLLLLGSRPARGAGPEPPVLPIRSEKEPLPVRGAAGCTFGGKVYALDETWHPDLGEPFGVMRCVLCACEAGP

SEQ ID NO: 26350 - protein, 955 aa, Homo sapiens
  ENSP00000204604
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 26351 - protein, 94 aa, Homo sapiens
  ENSP00000408624
MPSLPAPPAPLLLLGLLLLGSRPARGAGPEPPVLPIRSEKEPLPVRGAAGCTFGGKVYALDETWHPDLGEPFGVMRCVLCACEATGTLRPREMK

SEQ ID NO: 26352 - protein, 350 aa, Homo sapiens
  ENSP00000392794
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGDSTPGAATARTSGQCLSPGTRLC

SEQ ID NO: 26353 - protein, 954 aa, Homo sapiens
  ENSP00000408972
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPPETRTDPELEKEAEGS

SEQ ID NO: 26354 - protein, 915 aa, Homo sapiens
  ENSP00000334036
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 26355 - protein, 460 aa, Homo sapiens
  ENSP00000306490
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 26356 - protein, 454 aa, Homo sapiens
  ENSP00000441188
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHR

SEQ ID NO: 26357 - protein, 134 aa, Homo sapiens
  ENSP00000444482
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYR

SEQ ID NO: 26358 - protein, 590 aa, Homo sapiens
  ENSP00000255380
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 26359 - protein, 109 aa, Homo sapiens
  ENSP00000404764
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLS

SEQ ID NO: 26360 - protein, 590 aa, Homo sapiens; identical to SEQ ID NO: 26358
  ENSP00000482377

SEQ ID NO: 26361 - protein, 505 aa, Homo sapiens
  ENSP00000452896
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 26362 - protein, 489 aa, Homo sapiens
  ENSP00000267951
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEEQKAQEIQQLKRKEKSTETSDQEPGL

SEQ ID NO: 26363 - protein, 505 aa, Homo sapiens; identical to SEQ ID NO: 26361
  ENSP00000315602

SEQ ID NO: 26364 - protein, 17 aa, Homo sapiens
  ENSP00000453993
MSQLVKVDEVNQIMETN

SEQ ID NO: 26365 - protein, 411 aa, Homo sapiens
  ENSP00000309270
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 26366 - protein, 356 aa, Homo sapiens
  ENSP00000264249
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 26367 - protein, 356 aa, Homo sapiens; identical to SEQ ID NO: 26366
  ENSP00000387309

SEQ ID NO: 26368 - protein, 141 aa, Homo sapiens
  ENSP00000387121
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVL

SEQ ID NO: 26369 - protein, 133 aa, Homo sapiens
  ENSP00000405922
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQ

SEQ ID NO: 26370 - protein, 142 aa, Homo sapiens
  ENSP00000387977
MQRKAGKKEHVQLRDKRNQEPQFRGNTARKCEPQAAEGRVSEWLRCDNMHHQWLLLAACFWVIFMFMVASKFITLTFKDPDVYSAKQEFLFLTTMPEVRKLPEEKHIPEELKPTGKELPDSQLVQPLVYMERLELIRNVCRD

SEQ ID NO: 26371 - protein, 85 aa, Homo sapiens
  ENSP00000407525
MHHQWLLLAACFWVIFMFMVASKFITLTFKDPDVYSAKQEFLFLTTMPEVRKLPEEKHIPEELKPTGKELPDSQLVQPLVYMERL

SEQ ID NO: 26372 - protein, 64 aa, Homo sapiens
  ENSP00000416831
MHHQWLLLAACFWVIFMFMVASKFITLTFKDPDVYSAKQEFLFLTTMPEVRKLPEEKHIPEELK

SEQ ID NO: 26373 - protein, 33 aa, Homo sapiens
  ENSP00000395643
MHHQWLLLAACFWVIFMFMVASKFITLTFKDPD

SEQ ID NO: 26374 - protein, 77 aa, Homo sapiens
  ENSP00000449093
MKPALLEVMRMNRICRMVLATCLGSFILVIFYFQSMLHPVMRRNPFGVDICCRKGSRSPLQELYNPIQVSFKHSVSM

SEQ ID NO: 26375 - protein, 347 aa, Homo sapiens
  ENSP00000450004
MKPALLEVMRMNRICRMVLATCLGSFILVIFYFQIMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 26376 - protein, 352 aa, Homo sapiens
  ENSP00000305725
MKPALLEVMRMNRICRMVLATCLGSFILVIFYFQSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 26377 - protein, 72 aa, Homo sapiens
  ENSP00000448678
MKPALLEVMRMNRICRMVLATCLGSFILVIFYFQIMRRNPFGVDICCRKGSRSPLQELYNPIQVSFKHSVSM

SEQ ID NO: 26378 - protein, 158 aa, Homo sapiens
  ENSP00000449095
MRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRN

SEQ ID NO: 26379 - protein, 414 aa, Homo sapiens
  ENSP00000258711
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 26380 - protein, 245 aa, Homo sapiens
  ENSP00000411207
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVR

SEQ ID NO: 26381 - protein, 414 aa, Homo sapiens; identical to SEQ ID NO: 26379
  ENSP00000481912

SEQ ID NO: 26382 - protein, 561 aa, Homo sapiens
  ENSP00000333947
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLGPLSEKQEALMTKSPASNARRPEDRNLGPMWPITQKILRDFYRPFNARLAQVLADEAFAWKTT

SEQ ID NO: 26383 - protein, 506 aa, Homo sapiens
  ENSP00000485905
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVCTPPPRTPRAGPWQKELVCCYYASGIVGLRFSIGTERSVLMCKCCSPLFMDVKAEN

SEQ ID NO: 26384 - protein, 66 aa, Homo sapiens
  ENSP00000487014
MRHCINCCIQLLPDGAHKQQVNCQGGPHHGHQACPTCKGENKILFRVDSKQMNLLAVLEVRTEGNE

SEQ ID NO: 26385 - protein, 561 aa, Homo sapiens; identical to SEQ ID NO: 26382
  ENSP00000402394

SEQ ID NO: 26386 - protein, 411 aa, Homo sapiens
  ENSP00000338783
MGMRARVPKVAHSTRRPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 26387 - protein, 99 aa, Homo sapiens
  ENSP00000454375
MSRHLPWICDQRCSSPSSPGRWPPAARMWLPRFSSKTVTVLLLAQTTCLLLFIISRPGPSSPAGGEDRVHVLVLSSWRSGSSFLGQLFSQHPDVFYLME

SEQ ID NO: 26388 - protein, 178 aa, Homo sapiens
  ENSP00000467012
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTP

SEQ ID NO: 26389 - protein, 424 aa, Homo sapiens
  ENSP00000393879
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTPRHVSRIFVEDRHRVLYCEVPKAGCSNWKRVLMVLAGLASSTADIQHNTVHYGSALKRLDTFDRQGILHRLSTYTKMLFVREPFERLVSAFRDKFEHPNSYYHPVFGKAILARYRANASREALRTGSGVRFPEFVQYLLDVHRPVGMDIHWDHVSRLCSPCLIDYDFVGKFESMEDDANFFLSLIRAPRNLTFPRFKDRHSQEARTTARIAHQYFAQLSALQRQRTYDFYYMDYLMFNYSKPFADLY

SEQ ID NO: 26390 - protein, 424 aa, Homo sapiens; identical to SEQ ID NO: 26389
  ENSP00000262622

SEQ ID NO: 26391 - protein, 424 aa, Homo sapiens; identical to SEQ ID NO: 26389
  ENSP00000392604

SEQ ID NO: 26392 - protein, 443 aa, Homo sapiens
  ENSP00000480991
MQPSEMVMNPKQVFLSVLIFGVAGLLLFMYLQVWIEEQHTGRVEKRREQKVTSGWGPVKYLRPVPRIMSTEKIQEHITNQNPKFHMPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 26393 - protein, 443 aa, Homo sapiens; identical to SEQ ID NO: 26392
  ENSP00000462852

SEQ ID NO: 26394 - protein, 74 aa, Homo sapiens
  ENSP00000464655
MQPSEMVMNPKQVFLSVLIFGVAGLLLFMYLQVWIEEQHTGRVEKRREQKVTSGWGPVKYLRPVPRIKPQVSHA

SEQ ID NO: 26395 - protein, 802 aa, Homo sapiens
  ENSP00000254190
MAARGRRAWLSVLLGLVLGFVLASRLVLPRASELKRAGPRRRASPEGCRSGQAAASQAGGARGDARGAQLWPPGSDPDGGPRDRNFLFVGVMTAQKYLQTRAVAAYRTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 26396 - protein, 882 aa, Homo sapiens
  ENSP00000302629
MAVRSRRPWMSVALGLVLGFTAASWLIAPRVAELSERKRRGSSLCSYYGRSAAGPRAGAQQPLPQPQSRPRQEQSPPPARQDLQGPPLPEAAPGITSFRSSPWQQPPPLQQRRRGREPEGATGLPGAPAAEGEPEEEDGGAAGQRRDGRPGSSHNGSGDGGAAAPSARPRDFLYVGVMTAQKYLGSRALAAQRTWARFIPGRVEFFSSQQPPNAGQPPPPLPVIALPGVDDSYPPQKKSFMMIKYMHDHYLDKYEWFMRADDDVYIKGDKLEEFLRSLNSSKPLYLGQTGLGNIEELGKLGLEPGENFCMGGPGMIFSREVLRRMVPHIGECLREMYTTHEDVEVGRCVRRFGGTQCVWSYEMQQLFHENYEHNRKGYIQDLHNSKIHAAITLHPNKRPAYQYRLHNYMLSRKISELRYRTIQLHRESALMSKLSNTEVSKEDQQLGVIPSFNHFQPRERNEVIEWEFLTGKLLYSAAENQPPRQSLSSILRTALDDTVLQVMEMINENAKSRGRLIDFKEIQYGYRRVNPMHGVEYILDLLLLYKRHKGRKLTVPVRRHAYLQQLFSKPFFRETEELDVNSLVESINSETQSFSFISNSLKILSSFQGAKEMGGHNEKKVHILVPLIGRYDIFLRFMENFENMCLIPKQNVKLVIILFSRDSGQDSSKHIELIKGYQNKYPKAEMTLIPMKGEFSRGLGLEMASAQFDNDTLLLFCDVDLIFREDFLQRCRDNTIQGQQVYYPIIFSQYDPKVTNGGNPPTDDYFIFSKKTGFWRDYGYGITCIYKSDLLGAGGFDTSIQGWGLEDVDLYNKVILSGLRPFRSQEVGVVHIFHPVHCDPNLDPKQYKMCLGSKASTFASTMQLAELWLEKHLGVRYNRTLS

SEQ ID NO: 26397 - protein, 975 aa, Homo sapiens
  ENSP00000262315
MEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 26398 - protein, 103 aa, Homo sapiens
  ENSP00000456998
MEDYEQELCGVEDDFHNQFAAELEGRRLRRPPGSPCSPRADPRGRSRRPLPEGTRPPVPPQPHLWAAARAAPGRGRWTPTCSRPGPCPTPPGSNGLGCRWSRG

SEQ ID NO: 26399 - protein, 1003 aa, Homo sapiens
  ENSP00000406252
MEDYEQELCGVEDDFHNQFAAELEVLAELEGASTPSPSGVPLFTAGRPPRTFEEALARGDAASSPAPAASVGSSQGGARKRQVDADLQPAGSLPHGRLAALPQGLRSGREAEEASGSLHVSPPAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 26400 - protein, 456 aa, Homo sapiens
  ENSP00000399111
MEDYEQELCGVEDDFHNQFAAELEVLAELEAGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGVSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVVGSLMPGPPSTSS

SEQ ID NO: 26401 - protein, 264 aa, Homo sapiens
  ENSP00000412015
  MOD_RES (1)..(1): Any amino acid
XTPPPSPEDLAELWGHGVSEAAADVGLTRASPAARNPVLRRPPILEDYVHVTSTEGVRAYLVLRADPMAPGVQLTHLDGFIPLAPLSSLPPLTGQLTGGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQK

SEQ ID NO: 26402 - protein, 81 aa, Homo sapiens
  ENSP00000454679
  MOD_RES (1)..(1): Any amino acid
XSRSTASGGSGCFRRPRSFQTPCTVSGRGRRRQPSPWGPLRRSRLTVKTPPVTASGWMSLHPATTRSCSVMTSPTAACSSG

SEQ ID NO: 26403 - protein, 1184 aa, Homo sapiens
  ENSP00000486314
MHVNASARRWGRGGAAALPGPAASPRRPAPRTGPVGRPTLAPSPSRAHAHAKTNLLPGRAVQAPDAVPGAGSSRAPARWRPRDPGSSAPDAWQRFRPAPLRAQPRPPPRPAPGPPPPRKGGCGGQWRAPQDRTRGLRSRNSPRPPLAQPRLRHANQWRAPPGTPAADWRRPARSGRAVRDGGGGAGGSERELGLADGMEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGFSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEGMRADPGVLAALCEKTDNDIRACINTLQFLYSRGQRELSVRDVQATRVGLKDQRRGLFSVWQEVFQLPRAQRSSQHVSVLTCHGTPGDAGLVVLQDMGDAGLGLWDVLLLAWTRRGTFPGRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 26404 - protein, 975 aa, Homo sapiens
  ENSP00000313029
MEDYEQELCGVEDDFHNQFAAELEVLAELEGASTPSPSGVPLFTAGRPPRTFEEALARGDAASSPAPAASVGSSQGGARKRQVDADLQPAGSLPHAPRIKRPRLQVVKRLNFRSEEMEEPPPPDSSPTDITPPPSPEDLAELWGHGFSEAAADVGLTRASPAARNPVLRRPPILEDYVHVTSTEGVRAYLVLRADPMAPGVQGSLLHVPWRGGGQLDLLGVSLASLKKQVDGERRERLLQEAQKLSDTLHSLRSGEEEAAQPLGAPEEEPTDGQDASSHCLWVDEFAPRHYTELLSDDFTNRCLLKWLKLWDLVVFGHERPSRKPRPSVEPARVSKEATAPGKWKSHEQVLEEMLEAGLDPSQRPKQKVALLCGPPGLGKTTLAHVIARHAGYSVVEMNASDDRSPEVFRTRIEAATQMESVLGAGGKPNCLVIDEIDGAPVAAINVLLSILNRKGPQEVGPQGPAVPSGGGRRRRAEGGLLMRPIICICNDQFAPSLRQLKQQAFLLHFPPTLPSRLVQRLQEVSLRQGMRADPGVLAALCEKTDNDIRACINTLQFLYSRGQRELSVRDVQATRVGLKDQRRGLFSVWQEVFQLPRAQRRRVGQDPALPADTLLLGDGDAGSLTSASQRFYRVLHAAASAGEHEKVVQGLFDNFLRLRLRDSSLGAVCVALDWLAFDDLLAGAAHHSQSFQLLRYPPFLPVAFHVLFASSHTPRITFPSSQQEAQNRMSQMRNLIQTLVSGIAPATRSRATPQALLLDALCLLLDILAPKLRPVSTQLYSTREKQQLASLVGTMLAYSLTYRQERTPDGQYIYRLEPNVEELCRFPELPARKPLTYQTKQLIAREIEVEKMRRAEASARVENSPQVDGSPPGLEGLLGGIGEKGVHRPAPRNHEQRLEHIMRRAAREEQPEKDFFGRVVVRSTAVPSAGDTAPEQDSVERRMGTAVGRSEVWFRFNEGVSNAVRRSLYIRDLL

SEQ ID NO: 26405 - protein, 399 aa, Homo sapiens
  ENSP00000355319
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSRNYLPILNSYTKIAPHPGKRGLSLGPEEKGTSGVQKKICTERLGPSLSSSEPTKAGAVPSSPSTPAPPSAKLAEDSALQGVPSLVAGGSPQTLQPVSSSHVAKAPSLTFASPASPVCASDSTLHGLESNSPLSPLSANYSSPLWAAEHLCRSPDIFSEQRQSKHRRFQNTLVVLHKSGLLEITLKTKELIRQNQATQVELDQLKEQTQLFIEATKSRAPQAWAKLQASLTPGSSNTGSDLEAFSDHPAI

SEQ ID NO: 26406 - protein, 61 aa, Homo sapiens
  ENSP00000451997
MERKNPSRESPRRLSAKVGKGTEMKKVARQLGMAAAESDKDSGFSGQQLIPAPVVDCPALL

SEQ ID NO: 26407 - protein, 103 aa, Homo sapiens
  ENSP00000450972
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQQ

SEQ ID NO: 26408 - protein, 134 aa, Homo sapiens
  ENSP00000451522
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPV

SEQ ID NO: 26409 - protein, 156 aa, Homo sapiens
  ENSP00000452589
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSRNYLPI

SEQ ID NO: 26410 - protein, 151 aa, Homo sapiens
  ENSP00000452380
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPCHTGEKKSDSR

SEQ ID NO: 26411 - protein, 141 aa, Homo sapiens
  ENSP00000451493
MERKNPSRESPRRLSAKVGKGTEMKKVARQLGMAAAESDKDSGFSDGSSECLSSAEQMESEDMLSALGWSREDRPRQNSKTAKNAFPTLSPMVVMKNVLVKQGSSSSQLQSWTVQPSFEVISAQPQLLFLHPPVPSPVSPC

SEQ ID NO: 26412 - protein, 2069 aa, Homo sapiens
  ENSP00000376306
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEERRHSLENKVKRLETMERRENRLKDDIQTKSQQIQQMADKILELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 26413 - protein, 2027 aa, Homo sapiens
  ENSP00000261833
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 26414 - protein, 1640 aa, Homo sapiens
  ENSP00000376305
  MOD_RES (1)..(1): Any amino acid
XPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAVKASTEATELLQNIRQAKERAERELEKLQNREDSSEGIRKKLVEAEELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKADVPYILKMESHPHTTCWPGRTLYLLAPSFPDKQRWVTALESVVAGGRVSREKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKVWDQSSV

SEQ ID NO: 26415 - protein, 109 aa, Homo sapiens
  ENSP00000443199
IAELQELQPSAKDFEVRSLVGCGHFAEVQVVREKATGDIYAMKVMKKKALLAQEQVSFFEEERNILSRSTSPWIPQLQYAFQDKNHLYLVLYSHEKVKMEGTISQQTKL

SEQ ID NO: 26416 - protein, 162 aa, Homo sapiens
  ENSP00000446105
MRLLAPTTRLYNCEVKWTISAGRSRNERCSLPARSKKSLFKDKAQISATDLQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDK

SEQ ID NO: 26417 - protein, 482 aa, Homo sapiens
  ENSP00000482318
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSGG

SEQ ID NO: 26418 - protein, 241 aa, Homo sapiens
  ENSP00000413999
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMA

SEQ ID NO: 26419 - protein, 129 aa, Homo sapiens
  ENSP00000391990
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQER

SEQ ID NO: 26420 - protein, 96 aa, Homo sapiens
  ENSP00000416467
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMAS

SEQ ID NO: 26421 - protein, 103 aa, Homo sapiens
  ENSP00000396707
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIK

SEQ ID NO: 26422 - protein, 417 aa, Homo sapiens
  ENSP00000413255
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 26423 - protein, 203 aa, Homo sapiens
  ENSP00000411531
MAGPFSRLLSARPGLRLLALAGAGSLAAGFLLRPEPVRAASERRRLYPPSQTWPTGQLPGNCTRSRRLCPPSMVTGYPLPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRG

SEQ ID NO: 26424 - protein, 298 aa, Homo sapiens
  ENSP00000416717
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVVVGIK

SEQ ID NO: 26425 - protein, 58 aa, Homo sapiens
  ENSP00000399467
MAGPFSRLLSARPGLRLLALAGAGSLAAGFLLRPEPVRAASERRRLYPPRYLLTCLTL

SEQ ID NO: 26426 - protein, 417 aa, Homo sapiens; identical to SEQ ID NO: 26422
  ENSP00000300283

SEQ ID NO: 26427 - protein, 298 aa, Homo sapiens; identical to SEQ ID NO: 26424
  ENSP00000486477

SEQ ID NO: 26428 - protein, 674 aa, Homo sapiens
  ENSP00000221455
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 26429 - protein, 612 aa, Homo sapiens
  ENSP00000375815
MWHEARKHERKLRGMMVDYKKRAERRREYYEKIKKDPAQFLQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKPKLTPQEKLKLRMQKALNRQFKADKKAAQEKMIQQEHERQEREDELRAMARKIRMKERERREKEREEWERQYSRQSRSPSPRYSREYSSSRRRSRSRSRSPHYRH

SEQ ID NO: 26430 - protein, 81 aa, Homo sapiens
  ENSP00000465750
MWHEARKHERKLRGMMVDYKKRAERRREYYEKISQRSSACTRSTLMSCTEASRDPAKMRRRSWQRRRLPSVIPTRTARWPR

SEQ ID NO: 26431 - protein, 594 aa, Homo sapiens
  ENSP00000375814
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVTQADASGEAETEDAEGAEQAVQGG

SEQ ID NO: 26432 - protein, 86 aa, Homo sapiens
  ENSP00000465562
MWHEARKHERKLRGMMVDYKKRAERRREYYEKIKKDPAQFLQVHGRACKVHLDSAVALAAESPVNMMPWQGDTNNMIDRFDVRAHL

SEQ ID NO: 26433 - protein, 655 aa, Homo sapiens
  ENSP00000438702
MWHEARKHERKLRGMMVDYKKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDEVIPDIDVEVDVDELNQEQVADLNKQATTYGMADGDFVRMLRKDKEEAEAIKHAKALEEEKAMYSGRRSRRQRREFREKRLRGRKISPPSYARRDSPTYDPYKRSPSESSSESRSRSRSPTPGREEKITFITSFGGSDEEAAAAAAAAAASGVTTGKPPAPPQPGGPAPGRNASARRRSSSSSSSSSASRTSSSRSSSRSSSRSRRGGGYYRSGRHARSRSRSWSRSRSRSRRYSRSRSRGRRHSGGGSRDGHRYSRSPARRGGYGPRRRSRSRSHSGDRYRRGGRGLRHHSSSRSRSSWSLSPSRSRSLTRSRSHSPSPSQSRSRSRSRSQSPSPSPAREKLTRPAASPAVGEKLKKTEPAAGKETGAAKVIKADKKAAQEKMIQQEHERQEREDELRAMARKIRMKERERREKEREEWERQYSRQSRSPSPRYSREYSSSRRRSRSRSRSPHYRH

SEQ ID NO: 26434 - protein, 188 aa, Homo sapiens
  ENSP00000466371
KKRAERRREYYEKIKKDPAQFLQVHGRACKVHLDSAVALAAESPVNMMPWQGDTNNMIDRFDVRAHLDHIPDYTPPLLTTISPEQESDERKCNYERYRGLVQNDFAGISEEQCLYQIYIDELYGGLQRPSEDEKKKLAEKKASIGYTYEDSTVAEVEKAAEKPEEEESAAEEESNSDEDETWRWTWMN

SEQ ID NO: 26435 - protein, 131 aa, Homo sapiens
  ENSP00000467177
PKLTPQEKLKLRMQKALNRQFKADKKAAQEKMIQQEHERQEREDELRAMARKIRMKVLEAPALPEFSVSSVPGQMLMPCLRRERERREKEREEWERQYSRQSRSPSPRYSREYSSSRRRSRSRSRSPHYRH

SEQ ID NO: 26436 - protein, 988 aa, Homo sapiens
  ENSP00000339867
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDGIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGLPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 26437 - protein, 76 aa, Homo sapiens
  ENSP00000395949
  MOD_RES (1)..(1): Any amino acid
XISPQAVGSGIPEMKTILRGVVLKEYLTMKAFVAKVVALTAGLGSGIPVGKEPVPVLQMSTPLSPVAPHGDRAWAA

SEQ ID NO: 26438 - protein, 102 aa, Homo sapiens
  ENSP00000400027
  MOD_RES (1)..(1): Any amino acid
XISPQAVGSGIPEMKTILRGVVLKEYLTMKAFVAKVVALTAGLGSGIPVGKEGPFVHIASICAAVLSKFMSVFCGVYEPVPVLQMSTPLSPVAPHGDRAWAA

SEQ ID NO: 26439 - protein, 173 aa, Homo sapiens
  ENSP00000425160
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCC

SEQ ID NO: 26440 - protein, 818 aa, Homo sapiens
  ENSP00000424603
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 26441 - protein, 866 aa, Homo sapiens
  ENSP00000261514
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGIVLGIITKKNILEHLEQLKQHVEPLAPPWHYNKKRYPPAYGPDGKPRPRFNNVQLNLTDEEREETEEEVYLLNSTTL

SEQ ID NO: 26442 - protein, 791 aa, Homo sapiens
  ENSP00000353857
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 26443 - protein, 138 aa, Homo sapiens
  ENSP00000425823
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLA

SEQ ID NO: 26444 - protein, 725 aa, Homo sapiens
  ENSP00000425323
MDASSDPYLPYDGGGDSIPLRELHKRGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLR

SEQ ID NO: 26445 - protein, 245 aa, Homo sapiens
  ENSP00000422678
  MOD_RES (1)..(1): Any amino acid
XAGVSVAFGAPIGGVLFSLEEVSYYFPLKTLWRSFFAALVAAFVLRSINPFGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMT

SEQ ID NO: 26446 - protein, 791 aa, Homo sapiens
  ENSP00000478336
MDASSDPYLPYDGGGDSIPLRELHKRGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 26447 - protein, 801 aa, Homo sapiens [sequence omitted]

SEQ ID NO: 26448 - protein, 816 aa, Homo sapiens
  ENSP00000365256
MAMWQGAMDNRGFQQGSFSSFQNSSSDEDLMDIPATAMDFSMRDDVPPLDREVGEDKSYNGGGIGSSNRIMDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 26449 - protein, 816 aa, Homo sapiens; identical to SEQ ID NO: 26448
  ENSP00000365259

SEQ ID NO: 26450 - protein, 64 aa, Homo sapiens
  ENSP00000476732
MAMWQGAMDNRGFQQGSFSSFQNSSSDEDLMDIPATAMDFSMRDDVPPLDREVGGIIIGDDNLS

SEQ ID NO: 26451 - protein, 746 aa, Homo sapiens
  ENSP00000365276
MDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 26452 - protein, 746 aa, Homo sapiens; identical to SEQ ID NO: 26451
  ENSP00000304257

SEQ ID NO: 26453 - protein, 211 aa, Homo sapiens
  ENSP00000295522
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 26454 - protein, 207 aa, Homo sapiens
  ENSP00000064724
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLALCALVATIWFPVCAHRETTIVSFGYSLYAGWIGAVLCLVGGCVILCCAGDAQAFGENRFYYTAGSSSPTHAKSAHV

SEQ ID NO: 26455 - protein, 165 aa, Homo sapiens
  ENSP00000417434
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLGCQLLWAKTESSLHSQHLVQFKQKYLEDFSYLQGD

SEQ ID NO: 26456 - protein, 214 aa, Homo sapiens
  ENSP00000390661
MEPAREPPSRARPPPPLAARPAPAPAAPRPRSPAEAEARGPEGLLRRSGSGYEGSTSWKAALEDTTTRLLLGAIAVLLFAILVVMSILASKGCIKCEAPCPEDWLLYGRKCYFFSEEPRDWNTGRQYCHTHEAVLAVIQSQKELEFMFKFTRREPWIGLRRVGDEFHWVNGDPFDPDTFTIAGPGECVFVEPTRLVSTECLMTRPWVCSKMAYT

SEQ ID NO: 26457 - protein, 108 aa, Homo sapiens
  ENSP00000428508
  MOD_RES (1)..(1): Any amino acid
XEGSTSWKAALEASKGCIKCEAPCPEDWLLYGRKCYFFSEEPRDWNTGRQYCHTHEAVLAVIQSQKELEFMFKFTRREPWIGLRRVGDEFHWVNGDPFDPDTFTIAGP

SEQ ID NO: 26458 - protein, 201 aa, Homo sapiens
  ENSP00000266456
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 26459 - protein, 247 aa, Homo sapiens
  ENSP00000432876
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 26460 - protein, 143 aa, Homo sapiens
  ENSP00000298523
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELISDQNHSYPRKPISKLCMDSRVSHL

SEQ ID NO: 26461 - protein, 168 aa, Homo sapiens
  ENSP00000379743
MEYHPDLENLDEDGYTQLHFDSQSNTRIAVVSEKGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 26462 - protein, 247 aa, Homo sapiens; identical to SEQ ID NO: 26459
  ENSP00000302569

SEQ ID NO: 26463 - protein, 116 aa, Homo sapiens
  ENSP00000436923
MEYHPDLENLDEDGYTQLHFDSQSNTRIAVVSEKGSCAASPPWRLIAVILGILCLVILVIAVVLGTMGTGQFLKDLSFLNNRRKLFGDPIQEATHWRMATFYQEIKRTTVNPHNHL

SEQ ID NO: 26464 - protein, 45 aa, Homo sapiens
  ENSP00000344723
MEYHPDLENLDEDGYTQLHFDSQSNTRIAVVSEKGIYSKTSVFPT

SEQ ID NO: 26465 - protein, 189 aa, Homo sapiens
  ENSP00000431461
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELISDQNHSYPRKPISKLCMDSRVSHL

SEQ ID NO: 26466 - protein, 192 aa, Homo sapiens
  ENSP00000434392
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELSLTLLPKLECSEAATSQAQVILPPQLPE

SEQ ID NO: 26467 - protein, 77 aa, Homo sapiens
  ENSP00000312089
MEYHPDLENLDEDGYTQLHFDSQSNTRIAVVSEKGSCAASPPWRLIAVILGILCLVILVIAVVLGTMAGFKAVEFKG

SEQ ID NO: 26468 - protein, 136 aa, Homo sapiens
  ENSP00000434954
MEYHPDLENLDEDGYTQLHFDSQSNTRIAVVSEKGSCAASPPWRLIAVILGILCLVILVIAVVLGTMGEYLVEEINNRQFSKQLLCARHSFKGLTCIIYFNLYIIWFYLYWVGAVNAHFTYKGCERLRGYFTFPGL

SEQ ID NO: 26469 - protein, 410 aa, Homo sapiens
  ENSP00000185206
MNDEDYSTIYDTIQNERTYEVPDQPEENESPHYDDVHEYLRPENDLYATQLNTHEYDFVSVYTIKGEETSLASVQSEDRGYLLPDEIYSELQEAHPGEPQEDRGISMEGLYSSTQDQQLCAAELQENGSVMKEDLPSPSSFTIQHSKAFSTTKYSCYSDAEGLEEKEGAHMNPEIYLFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 26470 - protein, 251 aa, Homo sapiens
  ENSP00000344165
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKIVAKKYRNYDIPAEMTGLWRYLKNAYARDEFTNTCAADSEIELAYADVAKRLSRS

SEQ ID NO: 26471 - protein, 205 aa, Homo sapiens
  ENSP00000439195
MTDSATANGDDRDPEIELFVKAGIDGESIGNCPFSQRLFMILWLKGVVFNVTTVDLKRKPADLHNLAPGTHPPFLTFNGDVKTDVNKIEEFLEETLTPEKYPKLAAKHRESNTAGIDIFSKFSAYIKNTKQQNNAALERGLTKALKKLDDYLNTPLPEEIDANTCGEDKGSRRKFLDGDELTLADCNLLPKLHVVKEQVPLKGMI

SEQ ID NO: 26472 - protein, 704 aa, Homo sapiens
  ENSP00000353959
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKVKLTALGCSRIAIKKYLRAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 26473 - protein, 686 aa, Homo sapiens
  ENSP00000290332
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 26474 - protein, 484 aa, Homo sapiens
  ENSP00000326830
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 26475 - protein, 136 aa, Homo sapiens
  ENSP00000400487
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGMKLLIL

SEQ ID NO: 26476 - protein, 307 aa, Homo sapiens
  ENSP00000386358
MHLSNRGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 26477 - protein, 355 aa, Homo sapiens
  ENSP00000386875
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILDTR

SEQ ID NO: 26478 - protein, 526 aa, Homo sapiens
  ENSP00000394734
MAAGRRPASALWPERRGSPLRGDLLGFQNVREPSSCGETLSGMRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 26479 - protein, 454 aa, Homo sapiens
  ENSP00000479484
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGDEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 26480 - protein, 1002 aa, Homo sapiens
  ENSP00000298912
MAAHEWDWFQREELIGQISDIRVQNLQVERENVQKRTFTRWINLHLEKCNPPLEVKDLFVDIQDGKILMALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRKTRKYGVAVQDFAGSWRSGLAFLAVIKAIDPSLVDMKQALENSTRENLEKAFSIAQDALHIPRLLEPEDIMVDTPDEQSIMTYVAQFLERFPELEAEDIFDSDKEVPIESTFVRIKETPSEQESKVFVLTENGERTYTVNHETSHPPPSKVFVCDKPESMKEFRLDGVSSHALSDSSTEFMHQIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRKANSSGEAMSLGSHSPQSDSLTQLVQQPDMMYFILFLWLLVYCLLLFPQLDVSRL

SEQ ID NO: 26481 - protein, 67 aa, Homo sapiens
  ENSP00000452305
MKRESKHARMSMKANSSGEAMSLGSHSPQSDSLTQLVQQPDMMYFILFLWLLVYCLLLFPQLDVSRL

SEQ ID NO: 26482 - protein, 132 aa, Homo sapiens
  ENSP00000451705
MALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRK

SEQ ID NO: 26483 - protein, 101 aa, Homo sapiens
  ENSP00000452525
MALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSF

SEQ ID NO: 26484 - protein, 97 aa, Homo sapiens
  ENSP00000451189
MAAHEWDWFQREELIGQISDIRVQNLQVERENVQKRTFTRWINLHLEKCNPPLEVKDLFVDIQDGKILMALLEVLSGRNLSPGHQLLCPWWASTGSL

SEQ ID NO: 26485 - protein, 373 aa, Homo sapiens
  ENSP00000405577
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 26486 - protein, 955 aa, Homo sapiens
  ENSP00000402460
MLPGRLCWVPLLLALGVGSGSGGGGDSRQRRLLAAKVNKHKPWIETSYHGVITENNDTVILDPPLVALDKDAPVPFAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKVPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPSIATVVIIISVCMLVFVVAMGVYRVRIAHQHFIQETEAAKESEMDWDDSALTITVNPMEKHEGPGHGEDETEGEEEEEAEEEMSSSSGSDDSEEEEEEEGMGRGRHGQNGARQAQLEWDDSTLPY

SEQ ID NO: 26487 - protein, 134 aa, Homo sapiens
  ENSP00000443959
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVR

SEQ ID NO: 26488 - protein, 956 aa, Homo sapiens
  ENSP00000266546
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 26489 - protein, 142 aa, Homo sapiens
  ENSP00000442612
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQ

SEQ ID NO: 26490 - protein, 129 aa, Homo sapiens
  ENSP00000443468
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRV

SEQ ID NO: 26491 - protein, 154 aa, Homo sapiens
  ENSP00000443490
MENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTP

SEQ ID NO: 26492 - protein, 176 aa, Homo sapiens
  ENSP00000442801
MVVITNKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFL

SEQ ID NO: 26493 - protein, 968 aa, Homo sapiens
  ENSP00000440679
MVLGCELSGSTRVVVGVEALLTGASSPLPGVGPANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 26494 - protein, 327 aa, Homo sapiens
  ENSP00000275162
MTHLQAGLSPETLEKARLELNENPDTLHQDIQEVRDMVITRPDIGFLRTDDAFILRFLRARKFHHFEAFRLLAQYFEYRQQNLDMFKSFKATDPGIKQALKDGFPGGLANLDHYGRKILVLFAANWDQSRYTLVDILRAILLSLEAMIEDPELQVNGFVLIIDWSNFTFKQASKLTPSMLRLAIEGLQDSFPARFGGIHFVNQPWYIHALYTVIRPFLKEKTRKRIFLHGNNLNSLHQLIHPEILPSEFGGMLPPYDMGTWARTLLDHEYDDDSEYNVDSYSMPVKEVEKELSPKSMKRSQSVVDPTVLKRMDKNEEENMQPLLSLD

SEQ ID NO: 26495 - protein, 181 aa, Homo sapiens
  ENSP00000357423
MIEDPELQVNGFVLIIDWSNFTFKQASKLTPSMLRLAIEGLQDSFPARFGGIHFVNQPWYIHALYTVIRPFLKEKTRKRIFLHGNNLNSLHQLIHPEILPSEFGGMLPPYDMGTWARTLLDHEYDDDSEYNVDSYSMPVKEVEKELSPKSMKRSQSVVDPTVLKRMDKNEEENMQPLLSLD

SEQ ID NO: 26496 - protein, 227 aa, Homo sapiens
  ENSP00000272425
MAPCHIRKYQESDRQWVVGLLSRGMAEHAPATFRQLLKLPRTLILLLGGPLALLLVSGSWLLALVFSISLFPALWFLAKKPWTEYVDMTLCTDMSDITKSYLSERGSCFWVAESEEKVVGMVGALPVDDPTLREKRLQLFHLFVDSEHRRQGIAKALVRTVLQFARDQGYSEVILDTGTIQLSAMALYQSMGFKKTGQSFFCVWARLVALHTVHFIYHLPSSKVGSL

SEQ ID NO: 26497 - protein, 156 aa, Homo sapiens
  ENSP00000352270
MLSARDRRDRHPEEGVVAELQGFAVDKAFLTSHKGILLETELALTLIIFICFTASISAYMAAALLEFFITLAFLFLYATQYYQRFDRINWPCLDFLRCVSAIIIFLVVSFAAVTSRDGAAIAAFVFGIILVSIFAYDAFKIYRTEMAPGASQGDQQ

SEQ ID NO: 26498 - protein, 223 aa, Homo sapiens
  ENSP00000344819
MLSARDRRDRHPEEGVVAELQGFAVDKAFLTSHKGILLETELALTLIIFICFTASISAYMAAALLEFFITLAFLFLYATQYYQRFDRINWPCLLQGHGQSGGPHPLDLLSHSAKVQPQPWPGLTPPGWHTPAAVPWVPAPAPGFWSWLLWFICFHSLGSSDFLRCVSAIIIFLVVSFAAVTSRDGAAIAAFVFGIILVSIFAYDAFKIYRTEMAPGASQGDQQ

SEQ ID NO: 26499 - protein, 74 aa, Homo sapiens
  ENSP00000344160
MLSARDRRDRHPEEGVVAELQGFAVDKAFLTSHKGILLETELVFGIILVSIFAYDAFKIYRTEMAPGASQGDQQ

SEQ ID NO: 26500 - protein, 105 aa, Homo sapiens
  ENSP00000380404
MLSARDRRDRHPEEGVVAELQGFAVDKAFLTSHKGILLETELDFLRCVSAIIIFLVVSFAAVTSRDGAAIAAFVFGIILVSIFAYDAFKIYRTEMAPGASQGDQQ

SEQ ID NO: 26501 - protein, 118 aa, Homo sapiens
  ENSP00000451514
MLSARDRRDRHPEEGVVAELQGFAVDKAFLTSHKGILLETELYYQRFDRINWPCLDFLRCVSAIIIFLVVSFAAVTSRDGAAIAAFVFGIILVSIFAYDAFKIYRTEMAPGASQGDQQ

SEQ ID NO: 26502 - protein, 125 aa, Homo sapiens
  ENSP00000372259
MLSARDRRDRHPEEGVVAELQGFAVDKAFLTSHKGILLETELALTLIIFICFTASISAYMAAALLEFFITLAFLFLYATQYYQRFDRINWPCLVFGIILVSIFAYDAFKIYRTEMAPGASQGDQQ

SEQ ID NO: 26503 - protein, 115 aa, Homo sapiens
  ENSP00000412934
MEEPQRARSHTVTTTASSFAENFSTSSSSFAYDREFLRTLPGFLIVAEIGLCFNGSAFVLYLSAAVVDASSVSPERDSHNFNSWAASSFFAFLVTICYAGNTYFSFIAWRSRTIQ

SEQ ID NO: 26504 - protein, 173 aa, Homo sapiens
  ENSP00000307741
MEEPQRARSHTVTTTASSFAENFSTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 26505 - protein, 507 aa, Homo sapiens
  ENSP00000351682
MDPKLGRMAASLLAVLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 26506 - protein, 464 aa, Homo sapiens
  ENSP00000462096
MDPKLGRMTLKEWVAIESDSVQPVPRFRQELFRMMAVAADTLQRLGARVASVDMGPQQLPDGQSLPIPPVILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 26507 - protein, 38 aa, Homo sapiens
  ENSP00000463807
  MOD_RES (1)..(1): Any amino acid
XADRGDGWLTDPYVLTEGNFMDEERPTTKALSWLGSML

SEQ ID NO: 26508 - protein, 160 aa, Homo sapiens
  ENSP00000272133
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNADTLSYCQKEAWCKLAFYLLSFFYYLYCMIYTLVSS

SEQ ID NO: 26509 - protein, 555 aa, Homo sapiens
  ENSP00000475915
MEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 26510 - protein, 475 aa, Homo sapiens
  ENSP00000418975
MKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVIQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 26511 - protein, 178 aa, Homo sapiens
  ENSP00000393225
NIKPGEGLGMYIKSTYDGLHVITGTTENVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILP

SEQ ID NO: 26512 - protein, 421 aa, Homo sapiens
  ENSP00000377470
MNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 26513 - protein, 49 aa, Homo sapiens
  ENSP00000467641
MSSLGMSPGRRWTWSPTLERDPQACCIAQPSFVTTGRLPGQRSTLNKMC

SEQ ID NO: 26514 - protein, 164 aa, Homo sapiens
  ENSP00000468198
MDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSET

SEQ ID NO: 26515 - protein, 401 aa, Homo sapiens
  ENSP00000377466
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 26516 - protein, 144 aa, Homo sapiens
  ENSP00000413104
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEK

SEQ ID NO: 26517 - protein, 120 aa, Homo sapiens
  ENSP00000466807
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQ

SEQ ID NO: 26518 - protein, 153 aa, Homo sapiens
  ENSP00000468471
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADD

SEQ ID NO: 26519 - protein, 92 aa, Homo sapiens
  ENSP00000384514
MNDYKLEEDPVTKERTFKRFAPRKGDKIYQEFKKLYFYSDAYRPLKFACETIIEEYEDEISSLIAQETHYLADKLCSEKSDLCETSANHTEL

SEQ ID NO: 26520 - protein, 92 aa, Homo sapiens; identical to SEQ ID NO: 26519
  ENSP00000317439

SEQ ID NO: 26521 - protein, 164 aa, Homo sapiens
  ENSP00000490477
MVADTCNPSNSGGQACRALMDEIEHDITKARQKKTKVGSFRINPDGTQERRKIPLAQSEAFLTDLLEKVCERMNDYKLEEDPVTKERTFKRFAPRKGDKIYQEFKKLYFYSDAYRPLKFACETIIEEYEDEISSLIAQETHYLADKLCSEKSDLCETSANHTEL

SEQ ID NO: 26522 - protein, 145 aa, Homo sapiens
  ENSP00000490060
MDEIEHDITKARQKKTKVGSFRINPDGTQERRKIPLAQSEAFLTDLLEKVCERMNDYKLEEDPVTKERTFKRFAPRKGDKIYQEFKKLYFYSDAYRPLKFACETIIEEYEDEISSLIAQETHYLADKLCSEKSDLCETSANHTEL

SEQ ID NO: 26523 - protein, 472 aa, Homo sapiens
  ENSP00000358513
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 26524 - protein, 472 aa, Homo sapiens; identical to SEQ ID NO: 26523
  ENSP00000358511

SEQ ID NO: 26525 - protein, 472 aa, Homo sapiens; identical to SEQ ID NO: 26523
  ENSP00000446819

SEQ ID NO: 26526 - protein, 36 aa, Homo sapiens
  ENSP00000355418
MKSILDGLADTTFRTITTDLLYVGSNDIQYEDIKGE

SEQ ID NO: 26527 - protein, 439 aa, Homo sapiens
  ENSP00000420188
MKSILDGLADTTFRTITTDLLGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 26528 - protein, 472 aa, Homo sapiens; identical to SEQ ID NO: 26523
  ENSP00000412192

SEQ ID NO: 26529 - protein, 78 aa, Homo sapiens
  ENSP00000446702
MKSILDGLADTTFRTITTDLLYVGSNDIQYEDIKGDMASKLGYFPQKFPLTSFRGSPFQEKMTAGDNPQLVPADQVNI

SEQ ID NO: 26530 - protein, 372 aa, Homo sapiens
  ENSP00000242338
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 26531 - protein, 372 aa, Homo sapiens; identical to SEQ ID NO: 26530
  ENSP00000368265

SEQ ID NO: 26532 - protein, 256 aa, Homo sapiens
  ENSP00000388082
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQH

SEQ ID NO: 26533 - protein, 372 aa, Homo sapiens; identical to SEQ ID NO: 26530
  ENSP00000480451

SEQ ID NO: 26534 - protein, 41 aa, Homo sapiens
  ENSP00000491080
MGTATRRKPHLLLVAAVALVSSSGEDTEAQKSSITFPRSHS

SEQ ID NO: 26535 - protein, 1040 aa, Homo sapiens
  ENSP00000492617
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGTSMMVENMAVRPAPHPGTVISHSVAMLILIGSLEL

SEQ ID NO: 26536 - protein, 1040 aa, Homo sapiens; identical to SEQ ID NO: 26535
  ENSP00000330633

SEQ ID NO: 26537 - protein, 1085 aa, Homo sapiens
  ENSP00000491474
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGEMALWDPIRTPPLESSPRPGRNTRHEQVEELERSAHLTILQSKEEGQALGPRALPPSPSSSSKDPDAVPDNSLGAPACPSG

SEQ ID NO: 26538 - protein, 41 aa, Homo sapiens; identical to SEQ ID NO: 26534
  ENSP00000491665

SEQ ID NO: 26539 - protein, 1040 aa, Homo sapiens; identical to SEQ ID NO: 26535
  ENSP00000491671

SEQ ID NO: 26540 - protein, 764 aa, Homo sapiens
  ENSP00000491959
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTAGQHSLADRPGAWRRCPVLCLQQRERPALHAL

SEQ ID NO: 26541 - protein, 1040 aa, Homo sapiens; identical to SEQ ID NO: 26535
  ENSP00000492495

SEQ ID NO: 26542 - protein, 1011 aa, Homo sapiens
  ENSP00000489754
  MOD_RES (1)..(1): Any amino acid
XPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGAAPPLPLSPREIQDPPRYLRGSFPPRPTPISTRKGKWKAGRNQVQSSLRTASPPPFYPAPRTSPRAREGRRVQGEAEDQPAIANGLQSTVGVGLRRPPSRPLPGLQLALHKHDGGEHGSPPSTTPWHRHFPLRGDADPHRLPGALILEPLPLRRSWTPPPTDTASPFLLPRWPDTVPESGWF

SEQ ID NO: 26543 - protein, 473 aa, Homo sapiens
  ENSP00000491982
  MOD_RES (1)..(1): Any amino acid
XIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTQRERPALHAL

SEQ ID NO: 26544 - protein, 115 aa, Homo sapiens
  ENSP00000491680
  MOD_RES (1)..(1): Any amino acid
XGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPK

SEQ ID NO: 26545 - protein, 527 aa, Homo sapiens
  ENSP00000492457
  MOD_RES (1)..(1): Any amino acid
XAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGAAPPLPLSPREIQDPPRYLRGSFPPRPTPISTRKGKWKAGRNQVQSSLRTASPPPFYPAPRTSPRAREGRRVQGEAEDQPAIANGLQSTVGVGLRRPPSRPLPGLQLAL

SEQ ID NO: 26546 - protein, 1028 aa, Homo sapiens
  ENSP00000263665
MMFPWKQLILLSFIGCLGGELLLQGPVFIKEPSNSIFPVGSEDKKITLHCEARGNPSPHYRWQLNGSDIDMSMEHRYKLNGGNLVVINPNRNWDTGTYQCFATNSLGTIVSREAKLQFAYLENFKTKMRSTVSVREGQGVVLLCGPPPHSGELSYAWIFNEYPSFVEEDSRRFVSQETGHLYISKVEPSDVGNYTCVVTSMVTNARVLGSPTPLVLRSDGVMGEYEPKIEVQFPETLPAAKGSTVKLECFALGNPIPQINWRRSDGLPFSSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAENKHGLVYSSAELKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAVPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPPSQPPGNVVWNATDTKVLLNWEQVKAMENESEVTGYKVFYRTSSQNNVQVLNTNKTSAELVLPIKEDYIIEVKATTDGGDGTSSEQIRIPRITSMDARGSTSAISNVHPMSSYMPIVLFLIVYVLW

SEQ ID NO: 26547 - protein, 116 aa, Homo sapiens
  ENSP00000408594
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKL

SEQ ID NO: 26548 - protein, 232 aa, Homo sapiens
  ENSP00000396719
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFAYLDNFKTRTRSTVSVRRGQGMVLLCGPPPHSGELSYAWIFNEYPSYQDNRRFVSQETGNLYIAKVEKSDVGNYTCVVTNTVTNHKVLGPPTPLILRNDVQYQLLSGEELMESQ

SEQ ID NO: 26549 - protein, 54 aa, Homo sapiens
  ENSP00000390560
MRLPWELLVLQSFILCLADDSTLHGPIFIQEPSPVMFPLDSEEKKVKLNCEVKG

SEQ ID NO: 26550 - protein, 1026 aa, Homo sapiens
  ENSP00000396010
MRLPWELLVLQSFILCLADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFAYLDNFKTRTRSTVSVRRGQGMVLLCGPPPHSGELSYAWIFNEYPSYQDNRRFVSQETGNLYIAKVEKSDVGNYTCVVTNTVTNHKVLGPPTPLILRNDGVMGEYEPKIEVQFPETVPTAKGATVKLECFALGNPVPTIIWRRADGKPIARKARRHKSNGILEIPNFQQEDAGLYECVAENSRGKNVARGQLTFYAQPNWIQKINDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 26551 - protein, 1026 aa, Homo sapiens; identical to SEQ ID NO: 26550
  ENSP00000380602

SEQ ID NO: 26552 - protein, 137 aa, Homo sapiens
  ENSP00000404085
MRLPWELLVLQSFILCLAGSQTDFWSLLGVLPALEADDSTLHGPIFIQEPSPVMFPLDSEEKKVKLNCEVKGNPKPHIRWKLNGTDVDTGMDFRYSVVEGSLLINNPNKTQDAGTYQCTATNSFGTIVSREAKLQFA

SEQ ID NO: 26553 - protein, 698 aa, Homo sapiens
  ENSP00000380600
MEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENERITISEDGNLRIINVTKSDAGSYTCIATNHFGTASSTGNLVVKDPTRVMVPPSSMDVTVGESIVLPCQVTHDHSLDIVFTWSFNGHLIDFDRDGDHFERVGGQDSAGDLMIRNIQLKHAGKYVCMVQTSVDRLSAAADLIVRGPPGPPEAVTIDEITDTTAQLSWRPGPDNHSPITMYVIQARTPFSVGWQAVSTVPELIDGKTFTATVVGLNPWVEYEFRTVAANVIGIGEPSRPSEKRRTEEALPEVTPANVSGGGGSKSELVITWETVPEELQNGRGFGYVVAFRPYGKMIWMLTVLASADASRYVFRNESVHPFSPFEVKVGVFNNKGEGPFSPTTVVYSAEEEPTKPPASIFARSLSATDIEVFWASPLEKNRGRIQGYEVKYWRHEDKEENARKIRTVGNQTSTKITNLKGSVLYHLAVKAYNSAGTGPSSATVNVTTRKPPPSQPPGNIIWNSSDSKIILNWDQVKALDNESEVKGYKVLYRWNRQSSTSVIETNKTSVELSLPFDEDYIIEIKPFSDGGDGSSSEQIRIPKISNAYARGSGASTSNACTLSAISTIMISLTARSSL

SEQ ID NO: 26554 - protein, 143 aa, Homo sapiens
  ENSP00000422120
NDIHVAMEENVFWECKANGRPKPTYKWLKNGEPLLTRDRIQIEQGTLNITIVNLSDAGMYQCLAENKHGVIFSNAELSVIAVGPDFSRTLLKRVTLVKVGGEVVIECKPKASPKPVYTWKKGRDILKENESVHQGFGSGSAPL

SEQ ID NO: 26555 - protein, 1026 aa, Homo sapiens; identical to SEQ ID NO: 26550
  ENSP00000413642

SEQ ID NO: 26556 - protein, 911 aa, Homo sapiens
  ENSP00000433575
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEV

SEQ ID NO: 26557 - protein, 1100 aa, Homo sapiens
  ENSP00000436185
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 26558 - protein, 1100 aa, Homo sapiens; identical to SEQ ID NO: 26557
  ENSP00000435637

SEQ ID NO: 26559 - protein, 1026 aa, Homo sapiens
  ENSP00000393229
MASSWKLMLFLSVTMCLSESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 26560 - protein, 1022 aa, Homo sapiens [sequence omitted]

SEQ ID NO: 26561 - protein, 1084 aa, Homo sapiens
  ENSP00000279463
LTEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 26562 - protein, 1308 aa, Homo sapiens
  ENSP00000479811
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 26563 - protein, 1260 aa, Homo sapiens
  ENSP00000477698
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 26564 - protein, 1235 aa, Homo sapiens
  ENSP00000418741
MWNYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 26565 - protein, 1311 aa, Homo sapiens
  ENSP00000417628
MLLFYLLVVLSIDSTKASALTNPNVALFLLADDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 26566 - protein, 1260 aa, Homo sapiens
  ENSP00000439733
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGDLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 26567 - protein, 1308 aa, Homo sapiens
  ENSP00000306893
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGDLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 26568 - protein, 1306 aa, Homo sapiens
  ENSP00000399013
MDSLPRLTSVLTLLFSGLWHLGLTATNYNCDDPLASLLSPMAFSSSSDLTGTHSPAQLNWRVGTGGWSPADSNAQQWLQMDLGNRVEITAVATQGRYGSSDWVTSYSLMFSDTGRNWKQYKQEDSIWTFAGNMNADSVVHHKLLHSVRARFVRFVPLEWNPSGKIGMRVEVYGCSYKSDVADFDGRSSLLYRFNQKLMSTLKDVISLKFKSMQGDGVLFHGEGQRGDHITLELQKGRLALHLNLGDSKARLSSSLPSATLGSLLDDQHWHSVLIERVGKQVNFTVDKHTQHFRTKGETDALDIDYELSFGGIPVPGKPGTFLKKNFHGCIENLYYNGVNIIDLAKRRKHQIYTGNVTFSCSEPQIVPITFVNSSGSYLLLPGTPQIDGLSVSFQFRTWNKDGLLLSTELSEGSGTLLLSLEGGILRLVIQKMTERVAEILTGSNLNDGLWHSVSINARRNRITLTLDDEAAPPAPDSTWVQIYSGNSYYFGGCPDNLTDSQCLNPIKAFQGCMRLIFIDNQPKDLISVQQGSLGNFSDLHIDLCSIKDRCLPNYCEHGGSCSQSWTTFYCNCSDTSYTGATCHNSIYEQSCEVYRHQGNTAGFFYIDSDGSGPLGPLQVYCNITEDKIWTSVQHNNTELTRVRGANPEKPYAMALDYGGSMEQLEAVIDGSEHCEQEVAYHCRRSRLLNTPDGTPFTWWIGRSNERHPYWGGSPPGVQQCECGLDESCLDIQHFCNCDADKDEWTNDTGFLSFKDHLPVTQIVITDTDRSNSEAAWRIGPLRCYGDRRFWNAVSFYTEASYLHFPTFHAEFSADISFFFKTTALSGVFLENLGIKDFIRLEISSPSEITFAIDVGNGPVELVVQSPSLLNDNQWHYVRAERNLKETSLQVDNLPRSTRETSEEGHFRLQLNSQLFVGGTSSRQKGFLGCIRSLHLNGQKMDLEERAKVTSGVRPGCPGHCSSYGSICHNGGKCVEKHNGYLCDCTNSPYEGPFCKKEVSAVFEAGTSVTYMFQEPYPVTKNISLSSSAIYTDSAPSKENIALSFVTTQAPSLLLFINSSSQDFVVVLLCKNGSLQVRYHLNKEETHVFTIDADNFANRRMHHLKINREGRELTIQMDQQLRLSYNFSPEVEFRVIRSLTLGKVTENLGLDSEVAKANAMGFAGCMSSVQYNHIAPLKAALRHATVAPVTVHGTLTESSCGFMVDSDVNAVTTVHSSSDPFGKTDEREPLTNAVRSDSAVIGGVIAVVIFIIFCIIGIMTRFLYQHKQSHRTSQMKEKEYPENLDSSFRNEIDLQNTVSECKREYFI

SEQ ID NO: 26569 - protein, 1146 aa, Homo sapiens
  ENSP00000413498
LRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 26570 - protein, 1106 aa, Homo sapiens
  ENSP00000401204
LKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKALSAPRTASRFSTGTLSNTADARQALMDAIRSGTGAARLRKVPLLV

SEQ ID NO: 26571 - protein, 1261 aa, Homo sapiens
  ENSP00000265136
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKVASSASEELQSFRDAALSAQGSESPLLEDLGLLSPPAIPPPPPPPSQALSAPRTASRFSTGTLSNTADARQALMDAIRSGTGAARLRKVPLLV

SEQ ID NO: 26572 - protein, 614 aa, Homo sapiens
  ENSP00000405059
  MOD_RES (1)..(1): Any amino acid
XHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNL

SEQ ID NO: 26573 - protein, 469 aa, Homo sapiens
  ENSP00000378910
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYGAAEAVIRLLSLLLNTTAPGTAKPRTLWMSEGRSSLHNPEIKCSCFSSSSPFPQSLLSLLLGLSSICECMCTLRHTHAHTHNPSCVLPTSEILAFGRQSLIS

SEQ ID NO: 26574 - protein, 379 aa, Homo sapiens
  ENSP00000399500
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYCCASFPTQAKRF

SEQ ID NO: 26575 - protein, 394 aa, Homo sapiens
  ENSP00000488001
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRVRLSKTQSEPSLSCQETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMVYCCASFPTQAKRF

SEQ ID NO: 26576 - protein, 163 aa, Homo sapiens
  ENSP00000391864
MKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQN

SEQ ID NO: 26577 - protein, 1271 aa, Homo sapiens
  ENSP00000378912
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKGCLTTPNSPSMHSRSLTLGPSLSLGSISGVSVKSEMKKRRAPPPPGSGPPVQDKASEKVSLGSQIDLQKKKRRAPAPPPPQPPPPSPLIPNRTEDKEENRKSTMGGGRQVPQKPPRGTARGPPQLVLPPPPPYPPPDTDVVEPLSFPGEGAGSEASDPIPKLSLPLGSGSHCSPDGAPQVLSEAEETVSVGSCFASEDTTEDSGVMSSPSDIVSLDSQQDSMKYKDKWATDQEDCSDQDLAGTPDLGPQKSPLWEKNGSENSHLRTEKAVTASNDEEDLLIAGEFRKTLAELDEDLEEMEDSYETDTSSLTSSIHGASNHCPQDAMIPHGDTDAIPVTFIGEVSDDPVDSGLFSNRNNNAGSFDSEGVASRRDSLAPLQAEHSQPHEKAREEVPALHPASHDVGKGIRVALSNISKDGNLMETAPRVTSFASNLHTDNLNAKVKDKVYGCADGERTQATERVNSQPVNEKDSNDKNAALAPTSWHQRGQNPGKSYRLKHGLTTYKIIPPKSEMRCYDRDVSLSTGAIKIDELGNLVSPHATGIRIISLSSSVPEAESQPIGKVREFWRCNSVEKHLGRPSESSARGPPSTPVPTQTQNPESRLQADPKPISPQQKSAHHEGRNPLGEGRNQPPTMGMGHVRVPAAHTTEVTFLKPQRRTSSQYVASAIAKRIGAPKVHADVVRPHGYAEKGYAGKAPVLAAPPVTVKDDRTSSPHSETQGWKDGAQWPCVTPPNNHGEDLAVGAPPRGEVIGPHRKLSTQDRPAAIHRSSCFSLVQSSQRDRVSVGQSCGFSGKQSTSSQEASSASEPRRAPDGTDPPPPHTSDTQACSRELVNGSVRAPGHGEPSHPPGGSGTESHILLEREEKPSVFSTDGNETDSIWPPSIFGPKKKFKPVVQRPVPKDTSLHSALMEAIHSAGGKDRLRKTAEHTGEGRPAKLSYTEAEGERSALLAAIRGHSGTCSLRKALSAPRTASRFSTGTLSNTADARQALMDAIRSGTGAARLRKVPLLV

SEQ ID NO: 26578 - protein, 1806 aa, Homo sapiens
  ENSP00000359114
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 26579 - protein, 694 aa, Homo sapiens
  ENSP00000489428
  MOD_RES (1)..(1): Any amino acid
XPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKDFRCHWFHWIPWVSRCQWRERCTGSSWQTRPSGSAWSNGSSRFKRCKRSHWETWAKGHFRWRWPSWPSR

SEQ ID NO: 26580 - protein, 1690 aa, Homo sapiens
  ENSP00000426533
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 26581 - protein, 569 aa, Homo sapiens
  ENSP00000408640
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGD

SEQ ID NO: 26582 - protein, 200 aa, Homo sapiens
  ENSP00000410177
YRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEVRSTRPEKVFVFQ

SEQ ID NO: 26583 - protein, 1767 aa, Homo sapiens
  ENSP00000302551
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 26584 - protein, 1818 aa, Homo sapiens
  ENSP00000351163
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEKKKSNFKKKMRTVATKSKEKSKKFTPPKSEKFSSKKKKSYQASAKAKLGVKANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 26585 - protein, 1650 aa, Homo sapiens
  ENSP00000408123
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26586 - protein, 624 aa, Homo sapiens
  ENSP00000416619
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 26587 - protein, 290 aa, Homo sapiens
  ENSP00000396587
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 26588 - protein, 1629 aa, Homo sapiens
  ENSP00000449320
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26589 - protein, 1736 aa, Homo sapiens
  ENSP00000448715
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26590 - protein, 1650 aa, Homo sapiens
  ENSP00000388309
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26591 - protein, 624 aa, Homo sapiens
  ENSP00000388775
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 26592 - protein, 290 aa, Homo sapiens
  ENSP00000400813
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 26593 - protein, 1629 aa, Homo sapiens
  ENSP00000446870
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26594 - protein, 1736 aa, Homo sapiens
  ENSP00000448931
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26595 - protein, 1650 aa, Homo sapiens; identical to SEQ ID NO: 26590
  ENSP00000372706

SEQ ID NO: 26596 - protein, 624 aa, Homo sapiens; identical to SEQ ID NO: 26591
  ENSP00000394196

SEQ ID NO: 26597 - protein, 290 aa, Homo sapiens; identical to SEQ ID NO: 26592
  ENSP00000372566

SEQ ID NO: 26598 - protein, 333 aa, Homo sapiens
  ENSP00000388108
  MOD_RES (1)..(1): Any amino acid
XNQSPQAHRSTVPHTAGLGQLCLLGFGMDWRASEAWMVPRAPKGAWDPRESQDLLDNRAPLGPRVFPGPRVPSALMERRVLKGSQGSPACLGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26599 - protein, 1736 aa, Homo sapiens; identical to SEQ ID NO: 26594
  ENSP00000448701

SEQ ID NO: 26600 - protein, 1629 aa, Homo sapiens; identical to SEQ ID NO: 26593
  ENSP00000450084

SEQ ID NO: 26601 - protein, 1623 aa, Homo sapiens
  ENSP00000404513
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26602 - protein, 597 aa, Homo sapiens
  ENSP00000415296
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 26603 - protein, 263 aa, Homo sapiens
  ENSP00000408523
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 26604 - protein, 1650 aa, Homo sapiens
  ENSP00000372565
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26605 - protein, 333 aa, Homo sapiens; identical to SEQ ID NO: 26598
  ENSP00000402987
  MOD_RES (1)..(1): Any amino acid

SEQ ID NO: 26606 - protein, 624 aa, Homo sapiens
  ENSP00000398170
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 26607 - protein, 290 aa, Homo sapiens; identical to SEQ ID NO: 26592
  ENSP00000410284

SEQ ID NO: 26608 - protein, 1736 aa, Homo sapiens
  ENSP00000449275
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26609 - protein, 1629 aa, Homo sapiens
  ENSP00000447864
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26610 - protein, 1650 aa, Homo sapiens; identical to SEQ ID NO: 26590
  ENSP00000363840

SEQ ID NO: 26611 - protein, 624 aa, Homo sapiens; identical to SEQ ID NO: 26606
  ENSP00000405520

SEQ ID NO: 26612 - protein, 290 aa, Homo sapiens; identical to SEQ ID NO: 26592
  ENSP00000378620

SEQ ID NO: 26613 - protein, 1736 aa, Homo sapiens
  ENSP00000339915
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 26614 - protein, 1629 aa, Homo sapiens; identical to SEQ ID NO: 26593
  ENSP00000355123

SEQ ID NO: 26615 - protein, 1650 aa, Homo sapiens; identical to SEQ ID NO: 26590
  ENSP00000408627

SEQ ID NO: 26616 - protein, 624 aa, Homo sapiens; identical to SEQ ID NO: 26606
  ENSP00000398256

SEQ ID NO: 26617 - protein, 290 aa, Homo sapiens; identical to SEQ ID NO: 26592
  ENSP00000406347

SEQ ID NO: 26618 - protein, 1736 aa, Homo sapiens; identical to SEQ ID NO: 26613
  ENSP00000447062

SEQ ID NO: 26619 - protein, 1629 aa, Homo sapiens; identical to SEQ ID NO: 26593
  ENSP00000450046

SEQ ID NO: 26620 - protein, 756 aa, Homo sapiens
  ENSP00000399812
VSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPEPYVPEGGAYLPEREPFIVPVEPERTAEYEDYGADEPAEEPPEPHRRWRRALPHGPGQ

SEQ ID NO: 26621 - protein, 3063 aa, Homo sapiens
  ENSP00000325146
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 26622 - protein, 1899 aa, Homo sapiens
  ENSP00000305147
MRSRLPPALAALGAALLLSSIEAEGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 26623 - protein, 2987 aa, Homo sapiens
  ENSP00000412864
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 26624 - protein, 3062 aa, Homo sapiens
  ENSP00000421216
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGTLLPL

SEQ ID NO: 26625 - protein, 207 aa, Homo sapiens
  ENSP00000423423
VIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVKT

SEQ ID NO: 26626 - protein, 638 aa, Homo sapiens
  ENSP00000393217
  MOD_RES (1)..(1): Any amino acid
XKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTPPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNL

SEQ ID NO: 26627 - protein, 1874 aa, Homo sapiens
  ENSP00000483232
MECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQHSRFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 26628 - protein, 582 aa, Homo sapiens
  ENSP00000430089
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGVKGQPGEKGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGLDGPTGERRTWWPEQTQSGRIA

SEQ ID NO: 26629 - protein, 717 aa, Homo sapiens
  ENSP00000381949
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26630 - protein, 695 aa, Homo sapiens
  ENSP00000346553
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26631 - protein, 683 aa, Homo sapiens
  ENSP00000350463
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26632 - protein, 645 aa, Homo sapiens
  ENSP00000428057
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26633 - protein, 668 aa, Homo sapiens
  ENSP00000430061
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26634 - protein, 686 aa, Homo sapiens
  ENSP00000428342
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26635 - protein, 610 aa, Homo sapiens
  ENSP00000430173
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGEDGLPVQGCWNK

SEQ ID NO: 26636 - protein, 247 aa, Homo sapiens
  ENSP00000381947
  MOD_RES (1)..(1): Any amino acid
XIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26637 - protein, 174 aa, Homo sapiens
  ENSP00000388774
  MOD_RES (1)..(1): Any amino acid
XGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 26638 - protein, 642 aa, Homo sapiens [sequence omitted]

SEQ ID NO: 26639 - protein, 1388 aa, Homo sapiens
  ENSP00000364140
MAPRRNNGQCWCLLMLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 26640 - protein, 1374 aa, Homo sapiens
  ENSP00000483455
MLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGKGAILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 26641 - protein, 1339 aa, Homo sapiens
  ENSP00000383191
MAPRCPWPWPRRRRLLDVLAPLVLLLGVRAASAEPERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 26642 - protein, 1519 aa, Homo sapiens
  ENSP00000347665
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 26643 - protein, 687 aa, Homo sapiens
  ENSP00000339118
GEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGQVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 26644 - protein, 280 aa, Homo sapiens
  ENSP00000415692
  MOD_RES (1)..(1): Any amino acid
XISVPGPPGPPGPPGPPGTMGASSGVRLWATRQAMLGQVHEVPEGWLIFVAEQEELYVRVQNGFRKVQDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWR

SEQ ID NO: 26645 - protein, 1754 aa, Homo sapiens
  ENSP00000352798
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 26646 - protein, 1464 aa, Homo sapiens
  ENSP00000225964
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 26647 - protein, 154 aa, Homo sapiens
  ENSP00000460459
MRSRRAFKDLRKEERGEGREVKNPSVPLRPGGKVVKLGVAVTTDNAPLPPVPVPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPG

SEQ ID NO: 26648 - protein, 1366 aa, Homo sapiens
  ENSP00000297268
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 26649 - protein, 1364 aa, Homo sapiens
  ENSP00000477719
MLSFVDTRTLLLLAVTLCLATCQFFETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 26650 - protein, 1284 aa, Homo sapiens
  ENSP00000351767
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPAGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQASHVSKFDSFHENTRPPMPILEQKLEPGTEPLGSPGTRSKALVPGEWGRGGRHLEGRGEPGAVGQMGSPGQQGASTQGLWE

SEQ ID NO: 26651 - protein, 1297 aa, Homo sapiens
  ENSP00000414753
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPGGSEWRETGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 26652 - protein, 401 aa, Homo sapiens
  ENSP00000410799
EHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGR

SEQ ID NO: 26653 - protein, 250 aa, Homo sapiens
  ENSP00000406345
ERPLGEMGSPPAAGFVTLGRLAKARGPRSSSAAFQLQMLQIVCSDTWADEDRCCELPASRDGETCPAFVSACSCSSETPGPPGPQGPPGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGG

SEQ ID NO: 26654 - protein, 1626 aa, Homo sapiens
  ENSP00000303153
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDFDLQRIVIYCDSRHAELETCCDIPSGPCQVTVVTEPPPPPPPQRPPTPGSEQIGFLKTINCSCPAGEKGEMGVAGPMGLPGPKGDIGAIGPVGAPGPKGEKGDVGIGPFGQGEKGEKGSLGLPGPPGRDGSKGMRGEPGELGEPGLPGEVGMRGPQGPPGLPGPPGRVGAPGLQGERGEKGTRGEKGERGLDGFPGKPGDTGQQGRPGPSGVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKAACGKVRGSENCALGGQCVKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 26655 - protein, 65 aa, Homo sapiens
  ENSP00000428244
GEPGELGEPGLPGEVGMRGPQGPPGLPGPPGRVGAPVSEGTCLGRGSTPSPGIKNQVLASSSTCI

SEQ ID NO: 26656 - protein, 1319 aa, Homo sapiens
  ENSP00000387655
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 26657 - protein, 540 aa, Homo sapiens
  ENSP00000375069
MGPGERAGGGGDAGKGNAAGGGGGGRSATTAGSRAVSALCLLLSVGSAAACLLLGVQAAALQGRVAALEEERELLRRAGPPGALDAWAEPHLERLLREKLDGLAKIRTAREAPSECVCPPGPPGRRGKPGRRGDPGPPGQSGRDGYPGPLGLDGKPGLPGPKGEKGAPGDFGPRGDQGQDGAAGPPGPPGPPGARGPPGDTGKDGPRGAQGPAGPKGEPGQDGEMGPKGPPGPKGEPGVPGKKGDDGTPSQPGPPGPKGEPGSMGPRGENGVDGAPGPKGEPGHRGTDGAAGPRGAPGLKGEQGDTVVIDYDGRILDALKGPPGPQGPPGPPGIPGAKGELGLPGAPGIDGEKGPKGQKGDPGEPGPAGLKGEAGEMGLSGLPGADGLKGEKGESASDSLQESLAQLIVEPGPPGPPGPPGPMGLQGIQGPKGLDGAKGEKGASGERGPSGLPGPVGPPGLIGLPGTKGEKGRPGEPGLDGFPGPRGEKGDRSERGEKGERGVPGRKGVKGQKGEPGPPGLDQPCPVGPDGLPVPGCWHK

SEQ ID NO: 26658 - protein, 393 aa, Homo sapiens [sequence omitted]

SEQ ID NO: 26659 - protein, 496 aa, Homo sapiens
  ENSP00000437131
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGSQWNERRKRRFWNAGSTGSFYHRPTRPTRSPWPTWPHGTSWTSWTKGSIWLRRKARIPGYRWSYGTPWPCRSQRRKR

SEQ ID NO: 26660 - protein, 29 aa, Homo sapiens
  ENSP00000426841
  MOD_RES (1)..(1): Any amino acid
XGPRGEKGDLGEKGEKGPDGLPMPGCWQK

SEQ ID NO: 26661 - protein, 654 aa, Homo sapiens
  ENSP00000382083
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKGFRGVKGEKGEPGQPGLDGLDAPCQLGPDGLPMPGCWQK

SEQ ID NO: 26662 - protein, 645 aa, Homo sapiens
  ENSP00000382078
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRGLPGFPTVAALHSNQILTVKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGDRGEKGDSGAQGPRGPPGQKGDQGATEIIDYNGNLHEALQGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGEPGLNGVKGLKGEPGQKGDRGPLGLPGASGLDGKPGSRGTDGPMGPHGPAGPKGERGEKGAMGEPGPRGPYGLPGFPGPRGEKGDLGEKGEKVTSPSQHVPCLILLLLSALLFSLCDSI

SEQ ID NO: 26663 - protein, 642 aa, Homo sapiens
  ENSP00000382077
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKVTSPSQHVPCLILLLLSALLFSLCDSI

SEQ ID NO: 26664 - protein, 70 aa, Homo sapiens
  ENSP00000422266
MLLKKHAGKGGGREPRSEDPTPAEQHCARTMPPCAVLAALLSVVAVVSCLYLGVKTNDLQARIAALESAK

SEQ ID NO: 26665 - protein, 333 aa, Homo sapiens [sequence omitted]

SEQ ID NO: 26666 - protein, 494 aa, Homo sapiens [sequence omitted]

SEQ ID NO: 26667 - protein, 1669 aa, Homo sapiens
  ENSP00000364979
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 26668 - protein, 519 aa, Homo sapiens
  ENSP00000443348
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPLLFQIHK

SEQ ID NO: 26669 - protein, 223 aa, Homo sapiens
  ENSP00000478222
MQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRV

SEQ ID NO: 26670 - protein, 1691 aa, Homo sapiens
  ENSP00000331902
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGPTGFQGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 26671 - protein, 1685 aa, Homo sapiens
  ENSP00000354505
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 26672 - protein, 174 aa, Homo sapiens
  ENSP00000424137
  MOD_RES (1)..(1): Any amino acid
XDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKMIRRYVLGFVASPK

SEQ ID NO: 26673 - protein, 115 aa, Homo sapiens
  ENSP00000423520
  MOD_RES (1)..(1): Any amino acid
XGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLVNLSQKR

SEQ ID NO: 26674 - protein, 73 aa, Homo sapiens
  ENSP00000424845
FASRNDYSYWLSTPEPMPMSMQPLKGQSIQPFISRCAVCEAPAVVIAVHSQTIQIPHCPQGWDSLWIGYSFMM

SEQ ID NO: 26675 - protein, 1838 aa, Homo sapiens
  ENSP00000360882
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 26676 - protein, 210 aa, Homo sapiens
  ENSP00000360885
  MOD_RES (1)..(1): Any amino acid
XRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCA

SEQ ID NO: 26677 - protein, 1838 aa, Homo sapiens
  ENSP00000481360
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 26678 - protein, 1745 aa, Homo sapiens
  ENSP00000264828
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 26679 - protein, 1028 aa, Homo sapiens
  ENSP00000355180
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 26680 - protein, 1026 aa, Homo sapiens [sequence omitted]

SEQ ID NO: 26681 - protein, 921 aa, Homo sapiens
  ENSP00000349790
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 26682 - protein, 678 aa, Homo sapiens
  ENSP00000315252
MAWTARDRGALGLLLLGLCLCAAQRGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 26683 - protein, 328 aa, Homo sapiens
  ENSP00000359527
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADTSP

SEQ ID NO: 26684 - protein, 742 aa, Homo sapiens
  ENSP00000383115
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGSSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 26685 - protein, 234 aa, Homo sapiens
  ENSP00000356491
MLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 26686 - protein, 626 aa, Homo sapiens
  ENSP00000354960
MAARPAATLAWSLLLLSSALLREGCRARFVAERDSEDDGEEPVVFPESPLQSPTVLVAVLARNAAHTLPHFLGCLERLDYPKSRMAIWAATDHNVDNTTEIFREWLKNVQRLYHYVEWRPMDEPESYPDEIGPKHWPTSRFAHVMKLRQAALRTAREKWSDYILFIDVDNFLTNPQTLNLLIAENKTIVAPMLESRGLYSNFWCGITPKGFYKRTPDYVQIREWKRTGCFPVPMVHSTFLIDLRKEASDKLTFYPPHQDYTWTFDDIIVFAFSSRQAGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 26687 - protein, 363 aa, Homo sapiens
  ENSP00000356490
MFSDCWLCPSLGSSGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 26688 - protein, 234 aa, Homo sapiens; identical to SEQ ID NO: 26685
  ENSP00000356491

SEQ ID NO: 26689 - protein, 626 aa, Homo sapiens; identical to SEQ ID NO: 26686
  ENSP00000354960

SEQ ID NO: 26690 - protein, 363 aa, Homo sapiens; identical to SEQ ID NO: 26687
  ENSP00000356490

SEQ ID NO: 26691 - protein, 238 aa, Homo sapiens
  ENSP00000263960
MAARTGHTALRRVVSGCRPKSATAAGAQAPVRNGRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 26692 - protein, 188 aa, Homo sapiens
  ENSP00000386785
MAARTGHTALRRVVSGCRPKSATAAGAQAPVRNGRYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 26693 - protein, 210 aa, Homo sapiens
  ENSP00000387223
MGVCVWRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 26694 - protein, 1042 aa, Homo sapiens
  ENSP00000273857
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 26695 - protein, 903 aa, Homo sapiens
  ENSP00000425597
MNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 26696 - protein, 975 aa, Homo sapiens
  ENSP00000424212
MKQSPALAPEERCRRAGSPKPVLRADDNNMGNGCSQKLATANLLRFLLLVLIPCICALVLLLVILLSYVGACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 26697 - protein, 1005 aa, Homo sapiens
  ENSP00000425401
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCACHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 26698 - protein, 734 aa, Homo sapiens
  ENSP00000423216
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCACHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCGELLVSAICCTLSCLSATEAEWILNYFLDFTDQVHLFCFTVIKADSADLCVLFPTHRKFPHEATSLFEISILYGKTFGFKML

SEQ ID NO: 26699 - protein, 938 aa, Homo sapiens
  ENSP00000484087
MKQSPALAPEERCRRAGSPKPVLRADDNNMGNGCSQKLATANLLRFLLLVLIPCICALVLLLVILLSYVGACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCACHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 26700 - protein, 474 aa, Homo sapiens
  ENSP00000261401
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 26701 - protein, 474 aa, Homo sapiens; identical to SEQ ID NO: 26700
  ENSP00000438341

SEQ ID NO: 26702 - protein, 165 aa, Homo sapiens
  ENSP00000447337
SKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 26703 - protein, 369 aa, Homo sapiens
  ENSP00000415554
MVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 26704 - protein, 159 aa, Homo sapiens
  ENSP00000448130
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAEKYAGTNCSS

SEQ ID NO: 26705 - protein, 480 aa, Homo sapiens
  ENSP00000447534
MRWKDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 26706 - protein, 125 aa, Homo sapiens
  ENSP00000449658
MVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADG

SEQ ID NO: 26707 - protein, 181 aa, Homo sapiens
  ENSP00000449330
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVS

SEQ ID NO: 26708 - protein, 169 aa, Homo sapiens
  ENSP00000447989
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINL

SEQ ID NO: 26709 - protein, 163 aa, Homo sapiens
  ENSP00000448527
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTG

SEQ ID NO: 26710 - protein, 162 aa, Homo sapiens
  ENSP00000448195
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGT

SEQ ID NO: 26711 - protein, 151 aa, Homo sapiens
  ENSP00000447049
MRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGG

SEQ ID NO: 26712 - protein, 527 aa, Homo sapiens
  ENSP00000394496
MYGPGSQLGKSGNNSWAKERGCSIACQGSLTSARLHAPSIGERPLSHMRWKDTMRRVVRQSKFRHVFGQAVKNDQCYDDIRVSRVTWDSSFCAVNPRFVAIIIEASGGGAFLVLPLHKTGRIDKSYPTVCGHTGPVLDIDWCPHNDQVIASGSEDCTVMVWQIPENGLTLSLTEPVVILEGHSKRVGIVAWHPTARNVLLSAGCDNAIIIWNVGTGEALINLDDMHSDMIYNVSWNRNGSLICTASKDKKVRVIDPRKQEIVAEKEKAHEGARPMRAIFLADGNVFTTGFSRMSERQLALWNPKNMQEPIALHEMDTSNGVLLPFYDPDTSIIYLCGKGDSSIRYFEITDESPYVHYLNTFSSKEPQRGMGYMPKRGLDVNKCEIARFFKLHERKCEPIIMTVPRKSDLFQDDLYPDTAGPEAALEAEEWFEGKNADPILISLKHGYIPGKNRDLKVVKKNILDSKPTANKKCDLISIPKKTTDTASVQNEAKLDEILKEIKSIKDTICNQDERISKLEQQMAKIAA

SEQ ID NO: 26713 - protein, 525 aa, Homo sapiens
  ENSP00000343746
MSWHPQYRSSKFRHVFGKPASKENCYDSVPITRSVHDNHFCAVNPHFIAVVTECAGGGAFLVIPLHQTGKLDPHYPKVCGHRGNVLDVKWNPFDDFEIASCSEDATIKIWSIPKQLLTRNLTAYRKELVGHARRVGLVEWHPTAANILFSAGYDYKVMIWNLDTKESVITSPMSTISCHQDVILSMSFNTNGSLLATTCKDRKIRVIDPRAGTVLQEASYKGHRASKVLFLGNLKKLMSTGTSRWNNRQVALWDQDNLSVPLMEEDLDGSSGVLFPFYDADTSMLYVVGKGDGNIRYYEVSADKPHLSYLTEYRSYNPQKGIGVMPKRGLDVSSCEIFRFYKLITTKSLIEPISMIVPRRSESYQEDIYPPTAGAQPSLTAQEWLSGMNRDPILVSLRPGSELLRPHPLPAERPIFNSMAPASPRLLNQTEKLAAEDGWRSSSLLEEKMPRWAAEHRLEEKKTWLTNGFDVFECPPPKTENELLQMFYRQQEEIRRLRELLTQREVQAKQLELEIKNLRMGSEQL

SEQ ID NO: 26714 - protein, 525 aa, Homo sapiens; identical to SEQ ID NO: 26713
  ENSP00000364218

SEQ ID NO: 26715 - protein, 475 aa, Homo sapiens
  ENSP00000261861
MSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 26716 - protein, 480 aa, Homo sapiens
  ENSP00000454783
MTVTKMSWRPQYRSSKFRNVYGKVANREHCFDGIPITKNVHDNHFCAVNTRFLAIVTESAGGGSFLVIPLEQTGRIEPNYPKVCGHQGNVLDIKWNPFIDNIIASCSEDTSVRIWEIPEGGLKRNMTEALLELHGHSRRVGLVEWHPTTNNILFSAGYDYKVLIWNLDVGEPVKMIDCHTDVILCMSFNTDGSLLTTTCKDKKLRVIEPRSGRVLQEANCKNHRVNRVVFLGNMKRLLTTGVSRWNTRQIALWDQEDLSMPLIEEEIDGLSGLLFPFYDADTHMLYLAGKGDGNIRYYEISTEKPYLSYLMEFRSPAPQKGLGVMPKHGLDVSACEVFRFYKLVTLKGLIEPISMIVPRRSDSYQEDIYPMTPGTEPALTPDEWLGGINRDPVLMSLKEGYKKSSKMVFKAPIKEKKSVVVNGIDLLENVPPRTENELLRMFFRQQDEIRRLKEELAQKDIRIRQLQLELKNLRNSPKNC

SEQ ID NO: 26717 - protein, 475 aa, Homo sapiens; identical to SEQ ID NO: 26715
  ENSP00000446250

SEQ ID NO: 26718 - protein, 475 aa, Homo sapiens; identical to SEQ ID NO: 26715
  ENSP00000443819

SEQ ID NO: 26719 - protein, 472 aa, Homo sapiens
  ENSP00000344562
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAERFAAHEGMRPMRAVFTRQGHIFTTGFTRMSQRELGLWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQQHTLETLLEEIKALRERVQAQEQRITALENMLCELVDGTD

SEQ ID NO: 26720 - protein, 432 aa, Homo sapiens
  ENSP00000463723
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVANNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQQHTLETLLEEIKALRERVQAQEQRITALENMLCELVDGTD

SEQ ID NO: 26721 - protein, 29 aa, Homo sapiens
  ENSP00000464621
  MOD_RES (1)..(1): Any amino acid
XADGKLLSTGFSRMSERQLALWDPFCCVA

SEQ ID NO: 26722 - protein, 471 aa, Homo sapiens
  ENSP00000462627
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKTLRIIDPRKGQVVAEQARPHEGARPLRAVFTADGKLLSTGFSRMSERQLALWDPNNFEEPVALQEMDTSNGVLLPFYDPDSSIVYLCGKGDSSIRYFEITDEPPFVHYLNTFSSKEPQRGMGFMPKRGLDVSKCEIARFYKLHERKCEPIIMTVPRKSDLFQDDLYPDTPGPEPALEADEWLSGQDAEPVLISLRDGYVPPKHRELRVTKRNILDVRPPSGPRRSQSASDAPLSQHTLETLLEEIKALRERVQAQEQRITALENMLCELVDGTD

SEQ ID NO: 26723 - protein, 198 aa, Homo sapiens
  ENSP00000464396
MSRRVVRQSKFRHVFGQAAKADQAYEDIRVSKVTWDSSFCAVNPKFLAIIVEAGGGGAFIVLPLAKTGRVDKNYPLVTGHTAPVLDIDWCPHNDNVIASASDDTTIMVWQIPDYTPMRNITEPIITLEGHSKRVGILSWHPTARNVLLSAGGDNVIIIWNVGTGEVLLSLDDMHPDVIHSVCWNSNGSLLATTCKDKT

SEQ ID NO: 26724 - protein, 74 aa, Homo sapiens
  ENSP00000468235
MVWQIPDYTPMRNITEPIITLEGHSKRVGILSWHPTARNVLLSAGGDNVIIIWNVGTGEVLLSLDDMHPDVIHS

SEQ ID NO: 26725 - protein, 472 aa, Homo sapiens; identical to SEQ ID NO: 26719
  ENSP00000373419

SEQ ID NO: 26726 - protein, 142 aa, Homo sapiens
  ENSP00000262428
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 26727 - protein, 73 aa, Homo sapiens
  ENSP00000457033
MSKRSKFALITWIGENVSGLQRAKTGTDKTLVKEVVQNFAKEFVISDRKELEEDFIKSELKKAGGANYDAQTE

SEQ ID NO: 26728 - protein, 48 aa, Homo sapiens
  ENSP00000480117
  MOD_RES (1)..(1): Any amino acid
XTIVPGEQGAEYQHFIQQCTGWSAVVQSQLTATSVSRVQEILLPQPPE

SEQ ID NO: 26729 - protein, 88 aa, Homo sapiens
  ENSP00000467959
MLDVEAQEPPKGKWSTPPFDPRFPSQNQIRNCYQNFLDYHRCLKTRTRRGKSTQPCEYYFRVYHSLCPISWVESWNEQIKNGIFAGKI

SEQ ID NO: 26730 - protein, 88 aa, Homo sapiens; identical to SEQ ID NO: 26729
  ENSP00000320672

SEQ ID NO: 26731 - protein, 88 aa, Homo sapiens; identical to SEQ ID NO: 26729
  ENSP00000467266

SEQ ID NO: 26732 - protein, 88 aa, Homo sapiens; identical to SEQ ID NO: 26729
  ENSP00000467128

SEQ ID NO: 26733 - protein, 88 aa, Homo sapiens; identical to SEQ ID NO: 26729
  ENSP00000476768

SEQ ID NO: 26734 - protein, 139 aa, Homo sapiens
  ENSP00000424830
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGD

SEQ ID NO: 26735 - protein, 476 aa, Homo sapiens
  ENSP00000386104
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 26736 - protein, 108 aa, Homo sapiens
  ENSP00000427629
  MOD_RES (1)..(1): Any amino acid
XLGAEAQEPGAPAAGMRRRRRLQQEDGISFEYHRYPELREALVSVWLQCTAISRIYTVGRSFEGRELLVIELSDNPGVHEPDCKLYEVGTLIPAPSSCLAHSGLEYTL

SEQ ID NO: 26737 - protein, 147 aa, Homo sapiens
  ENSP00000416601
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYD

SEQ ID NO: 26738 - protein, 157 aa, Homo sapiens
  ENSP00000423699
MHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEY

SEQ ID NO: 26739 - protein, 134 aa, Homo sapiens
  ENSP00000352544
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDTVLKYLPGPLQDMFKK

SEQ ID NO: 26740 - protein, 6 aa, Homo sapiens
  ENSP00000423564
MDFVMK

SEQ ID NO: 26741 - protein, 111 aa, Homo sapiens
  ENSP00000421106
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEE

SEQ ID NO: 26742 - protein, 134 aa, Homo sapiens; identical to SEQ ID NO: 26739
  ENSP00000377346

SEQ ID NO: 26743 - protein, 70 aa, Homo sapiens
  ENSP00000425973
MDFVMKQALGGATKDMGKMLGGEEEKDPDAQKKEEERQEALRQQEEERKAKHARMEAEREKVRQQIRDKD

SEQ ID NO: 26744 - protein, 119 aa, Homo sapiens
  ENSP00000423612
MDFVMKQALGGATKDMGKMLGGEEEKDPDAQKKEEERQEALRQQEEERKAKHARMEAEREKVRQQIRDKYGLKKKEEKEAEEKAALEQPCEGSLTRPKKAIPAGCGDEEEEEEESILDT

SEQ ID NO: 26745 - protein, 77 aa, Homo sapiens
  ENSP00000424305
MDFVMKQALGGATKDMGKMLGGEEEKDPDAQKKEEERQEALRQQEEERKAKHARMEAEREKVRQQIRDKYGLKKKEE

SEQ ID NO: 26746 - protein, 37 aa, Homo sapiens
  ENSP00000425284
MDFVMKQALGGATKDMGKMLGGEEEKDPDAQKKEEER

SEQ ID NO: 26747 - protein, 134 aa, Homo sapiens; identical to SEQ ID NO: 26739
  ENSP00000421825

SEQ ID NO: 26748 - protein, 158 aa, Homo sapiens
  ENSP00000378464
MAFMVKTMVGGQLKNLTGSLGGGEDKGDGDKSAAEAQGMSREEYEEYQKQLVEEKMERDAQFTQRKAERATLRSHFRDKYRLPKNETDESQIQMAGGDVELPRELAKMIEEDTEEEEEKASVLGQLASLPGLNLGSLKDKAQATLGDLKQSAEKCHVM

SEQ ID NO: 26749 - protein, 35 aa, Homo sapiens
  ENSP00000447051
SCPMIPLYRNLPDHSAATKPSLFLFLVSLLHIFFK

SEQ ID NO: 26750 - protein, 198 aa, Homo sapiens
  ENSP00000447455
  MOD_RES (1)..(1): Any amino acid
XPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKLRSFACNRGQDEFCLTSLMS

SEQ ID NO: 26751 - protein, 443 aa, Homo sapiens
  ENSP00000448517
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 26752 - protein, 443 aa, Homo sapiens; identical to SEQ ID NO: 26751
  ENSP00000447255

SEQ ID NO: 26753 - protein, 249 aa, Homo sapiens
  ENSP00000446799
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFP

SEQ ID NO: 26754 - protein, 64 aa, Homo sapiens
  ENSP00000446573
MDFPCLWLGLLLPLVAALDFNYHRQEGMEAFLKTVAQNYSSVTHLHSIGKSVKDCWAGAAAPSD

SEQ ID NO: 26755 - protein, 64 aa, Homo sapiens; identical to SEQ ID NO: 26754
  ENSP00000450400

SEQ ID NO: 26756 - protein, 136 aa, Homo sapiens
  ENSP00000449911
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKP

SEQ ID NO: 26757 - protein, 72 aa, Homo sapiens
  ENSP00000448078
MDFPCLWLGLLLPLVAALDFNYHRQEGMEAFLKTVAQNYSSVTHLHSIGKSVKETCGFLLWGGFQRNTELGF

SEQ ID NO: 26758 - protein, 443 aa, Homo sapiens; identical to SEQ ID NO: 26751
  ENSP00000339157

SEQ ID NO: 26759 - protein, 575 aa, Homo sapiens
  ENSP00000478878
MAVEPSSSESIKRRAGRRMKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 26760 - protein, 557 aa, Homo sapiens
  ENSP00000411904
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 26761 - protein, 169 aa, Homo sapiens
  ENSP00000425506
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDK

SEQ ID NO: 26762 - protein, 557 aa, Homo sapiens; identical to SEQ ID NO: 26760
  ENSP00000423811

SEQ ID NO: 26763 - protein, 575 aa, Homo sapiens; identical to SEQ ID NO: 26759
  ENSP00000424853

SEQ ID NO: 26764 - protein, 73 aa, Homo sapiens
  ENSP00000421394
MKKMSNIYESAANTLGIFNSPCLTKVELRVACKGISDRDALSKPDPCVILKMQSHGQWFEVDRTEVIRTCINP

SEQ ID NO: 26765 - protein, 82 aa, Homo sapiens
  ENSP00000427561
MKKMSNIYESAANTLGIFNSPCLTKVELRVACKGISDRDALSKPDPCVILKMQSHGQWFEVDRTEVIRTCINPVYSKLFTVD

SEQ ID NO: 26766 - protein, 575 aa, Homo sapiens; identical to SEQ ID NO: 26759
  ENSP00000421646

SEQ ID NO: 26767 - protein, 557 aa, Homo sapiens; identical to SEQ ID NO: 26760
  ENSP00000421705

SEQ ID NO: 26768 - protein, 633 aa, Homo sapiens
  ENSP00000268720
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQPAQKWLLQVVMRVSVDVLGPAGHCAKHFLCCTESSHLARTGPSFLLRYDDLCLPWATAGAVRWWTCRGGHTQGWQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 26769 - protein, 120 aa, Homo sapiens
  ENSP00000431863
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQV

SEQ ID NO: 26770 - protein, 558 aa, Homo sapiens
  ENSP00000317374
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 26771 - protein, 173 aa, Homo sapiens
  ENSP00000435876
FHRVYSFLDYIMGGCQIHFTTKRERGETGVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADT

SEQ ID NO: 26772 - protein, 98 aa, Homo sapiens
  ENSP00000455086
DSDKRFSALGFGARIPPKYEVSHDFAINFNPEDDECEAILHPADPDGRRGDRHGRHTGGHCACLTPAHVHHHRGRGQRRLHRHAGPGRRRRRPALPTG

SEQ ID NO: 26773 - protein, 92 aa, Homo sapiens
  ENSP00000434886
  MOD_RES (1)..(1): Any amino acid
XFVPFRELKNQRTAQGAPGIHHAASPVAANLCDPARHAQHTRIPCGAGQVRAGRGPEAGGGVLQPQRPAPEKPGCPCRRGQPRLHTVKMWRA

SEQ ID NO: 26774 - protein, 564 aa, Homo sapiens
  ENSP00000329748
MDSRYNSTAGIGDLNQLSAAIPATRVEVSVSCRNLLDRDTFSKSDPICVLYVQGVGNKEWREFGRTEVIDNTLNPDFVRKFILDYFFEERENLRFDLYDVDSKSPNLSKHDFLGQVFCTLGEIVGSQGSRLEKPIVGIPGKKCGTIILTAEELNCCRDAVLMQFCANKLDKKDFFGKSDPFLVFYRSNEDGSFTICHKTEVVKNTLNPVWQAFKISVRALCNGDYDRTIKVEVYDWDRDGSHDFIGEFTTSYRELSRGQSQFNVYEVVNPKKKGKKKKYTNSGTVTLLSFLVETEVSFLDYIKGGTQINFTVAIDFTASNGNPAQPTSLHYMNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPTHVLQTQI

SEQ ID NO: 26775 - protein, 233 aa, Homo sapiens
  ENSP00000439237
MNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPTHVLQTQI

SEQ ID NO: 26776 - protein, 552 aa, Homo sapiens
  ENSP00000353633
MHFKCSSLYMLYLTEVETNWINLLDRDTFSKSDPICVLYVQGVGNKEWREFGRTEVIDNTLNPDFVRKFILDYFFEERENLRFDLYDVDSKSPNLSKHDFLGQVFCTLGEIVGSQGSRLEKPIVGIPGKKCGTIILTAEELNCCRDAVLMQFCANKLDKKDFFGKSDPFLVFYRSNEDGSFTICHKTEVVKNTLNPVWQAFKISVRALCNGDYDRTIKVEVYDWDRDGSHDFIGEFTTSYRELSRGQSQFNVYEVVNPKKKGKKKKYTNSGTVTLLSFLVETEVSFLDYIKGGTQINFTVAIDFTASNGNPAQPTSLHYMNPYQLNAYGMALKAVGEIVQDYDSDKMFPALGFGAKLPPDGRISHEFALNGNPQNPYCDGIEGVMEAYYRSLKSVQLYGPTNFAPVINHVARYASSVKDGSQYFVLLIVTDGVISDMAQTKESIVNASKLPMSIIIVGVGPAEFDAMVELDGDDVRVSSRGKYAERDIVQFVPFRDYIDRSGNHILSMARLAKDVLAEIPEQFLSYMRARGIKPSPAPPPYTPPTHVLQTQI

SEQ ID NO: 26777 - protein, 12 aa, Homo sapiens
  ENSP00000447761
MQFCANKLDKKD

SEQ ID NO: 26778 - protein, 553 aa, Homo sapiens
  ENSP00000373343
MSLGGASERSVPATKIEITVSCRNLLDLDTFSKSDPMVVLYTQSRASQEWREFGRTEVIDNTLNPDFVRKFVLDYFFEEKQNLRFDVYNVDSKTNISKPKDFLGQAFLALGEVIGGQGSRVERTLTGVPGKKCGTILLTAEELSNCRDIATMQLCANKLDKKDFFGKSDPFLVFYRSNEDGTFTICHKTEVVKNTLNPVWQPFSIPVRALCNGDYDRTVKIDVYDWDRDGSHDFIGEFTTSYRELSKAQNQFTVYEVLNPRKKCKKKKYVNSGTVTLLSFSVDSEFTFVDYIKGGTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPAMFEAMEELDGDDVRVSSRGRYAERDIVQFVPFRDYVDRSGNQVLSMARLAKDVLAEIPEQLLSYMRTRDIQPRPPPPANPSPIPAPEQP

SEQ ID NO: 26779 - protein, 503 aa, Homo sapiens
  ENSP00000373342
MSLGGASERSVPATKIEITVSCRNLLDLDTFSKSDPMVVLYTQSRASQEWREFGRTEVIDNTLNPDFVRKFVLDYFFEEKQNLRFDVYNVDSKTNISKPKDFLGQAFLALGEVIGGQGSRVERTLTGVPGKKCGTILLTAEELSNCRDIATMQLCANKLDKKDFFGKSDPFLVFYRSNEDGTFTICHKTEVVKNTLNPVWQPFSIPVRALCNGDYDRTVKIDVYDWDRDGSHDFIGEFTTSYRELSKAQNQFTVYEVLNPRKKCKKKKYVNSGTVTLLSFSVDSEFTFVDYIKGGTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPAMFEAMEELDGDDVRVSSRGRYAERDIVQEGCCSLGTSVV

SEQ ID NO: 26780 - protein, 196 aa, Homo sapiens
  ENSP00000273027
  MOD_RES (1)..(1): Any amino acid
XRTSSQYMRFLTLGRNVRRRNMSTQELTQLNFTVAIDFTASNGNPLQPTSLHYMSPYQLSAYAMALKAVGEIIQDYDSDKLFPAYGFGAKLPPEGRISHQFPLNNNDEDPNCAGIEGVLESYFQSLRTVQLYGPTYFAPVINQVARAAAKISDGSQYYVLLIITDGVISDMTQTKEAIVSASSLPMSIIIVGVGPA

SEQ ID NO: 26781 - protein, 503 aa, Homo sapiens [sequence omitted]

SEQ ID NO: 26782 - protein, 476 aa, Homo sapiens
  ENSP00000265394
MVGAMWKVIVSLVLLMPGPCDGLFRSLYRSVSMPPKGDSGQPLFLTPYIEAGKIQKGRELSLVGPFPGLNMKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 26783 - protein, 476 aa, Homo sapiens; identical to SEQ ID NO: 26782
  ENSP00000379572

SEQ ID NO: 26784 - protein, 180 aa, Homo sapiens
  ENSP00000397327
  MOD_RES (1)..(1): Any amino acid
XKYFQKQCHECIEHIRKQNWFEAFEEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 26785 - protein, 141 aa, Homo sapiens
  ENSP00000403580
IIGGYAEFLYQIGLLDEKQKKYFQKQCHECIEHIRKQNWFEAFEVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 26786 - protein, 476 aa, Homo sapiens; identical to SEQ ID NO: 26782
  ENSP00000387164

SEQ ID NO: 26787 - protein, 244 aa, Homo sapiens
  ENSP00000409036
MKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNY

SEQ ID NO: 26788 - protein, 100 aa, Homo sapiens
  ENSP00000417015
MFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHL

SEQ ID NO: 26789 - protein, 141 aa, Homo sapiens
  ENSP00000395690
MKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVP

SEQ ID NO: 26790 - protein, 52 aa, Homo sapiens
  ENSP00000413287
MVGAMWKVIVSLVLLMPGPCDGLFRSLYRSVSMPPKGDSGQPLFLTPYIEAG

SEQ ID NO: 26791 - protein, 43 aa, Homo sapiens
  ENSP00000412857
MVGAMWKVIVSLVLLMPGPCDGLFRSLYRSVSMPPKGDSGQPL

SEQ ID NO: 26792 - protein, 6 aa, Homo sapiens
  ENSP00000416555
MVGAMW

SEQ ID NO: 26793 - protein, 519 aa, Homo sapiens
  ENSP00000481956
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 26794 - protein, 105 aa, Homo sapiens
  ENSP00000431677
MEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAA

SEQ ID NO: 26795 - protein, 123 aa, Homo sapiens
  ENSP00000436574
ISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANSFSSGIQPLLCSLIGLENPT

SEQ ID NO: 26796 - protein, 520 aa, Homo sapiens
  ENSP00000329140
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVVRSRNLLIYEEHSPPEESSSPGSAGELGGWDRGSSLLRVSGLESRPDVDLPHFIISNETSLEKSVLLELQQHLVSAKLEGNETLKVVELDRRVNTTF

SEQ ID NO: 26797 - protein, 460 aa, Homo sapiens
  ENSP00000403550
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVGKTACGKLGRVLFYFPRAGFLSLPKGIFCESPMFKKW

SEQ ID NO: 26798 - protein, 248 aa, Homo sapiens
  ENSP00000410314
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEGLSALPVSLWVMDMVSGSTEREYGERAGMSLYHRCCSWLYEIALFLKNKNFASK

SEQ ID NO: 26799 - protein, 185 aa, Homo sapiens
  ENSP00000388917
MEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEGLSALPVSLWVMDMVSGSTEREYGERAGMSLYHRCCSWLYEIALFLKNKNFASK

SEQ ID NO: 26800 - protein, 239 aa, Homo sapiens
  ENSP00000402889
NLPRRPRRLSSRLSTATPCARSLGPSRPSPTLPPVTASMTICYINSKWMYGPPSLCLGFASYEYCIFNPRLFEKNLLVSGPAWFKTRVVQGPTAYVFFSYEVESEKWYLSTDFPSTSIKTEPVTDEPPPGLVPSVTLTITAISTPLEKEEPPLEMNTGVDSSCQTIIPKIKLEPHEVDQFLNFSPKEGLSALPVSLWVMDMVSGSTEREYGERAGMSLYHRCCSWLYEIALFLKNKNFA

SEQ ID NO: 26801 - protein, 150 aa, Homo sapiens
  ENSP00000478432
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSICHSDHHSHLHPVGKGGTSSGNEHWG

SEQ ID NO: 26802 - protein, 175 aa, Homo sapiens [sequence omitted]

SEQ ID NO: 26803 - protein, 1036 aa, Homo sapiens
  ENSP00000280527
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 26804 - protein, 222 aa, Homo sapiens
  ENSP00000407636
CPGSIVQGVCGCCYTCASQRNESCGGTFGIYGTCDRGLRCVIRPPLNGDSLTEYEAGVCEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVN

SEQ ID NO: 26805 - protein, 55 aa, Homo sapiens
  ENSP00000415706
  MOD_RES (1)..(1): Any amino acid
XGCCYTCASQRNESCGGTFGIYGTCDRGLRCVIRPPLNGDSLTEYEAGVCEAAGY

SEQ ID NO: 26806 - protein, 175 aa, Homo sapiens
  ENSP00000403120
ALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIGGQT

SEQ ID NO: 26807 - protein, 51 aa, Homo sapiens
  ENSP00000480938
  MOD_RES (1)..(1): Any amino acid
XGCCYTCASQRNESCGGTFGIYGTCDRGLRCVIRPPLNGDSLTEYEAGVCE

SEQ ID NO: 26808 - protein, 60 aa, Homo sapiens
  ENSP00000480932
CPGSIVQGVCGCCYTCASQRNESCGGTFGIYGTCDRGLRCVIRPPLNGDSLTEYEAGVCE

SEQ ID NO: 26809 - protein, 110 aa, Homo sapiens
  ENSP00000478123
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCE

SEQ ID NO: 26810 - protein, 101 aa, Homo sapiens
  ENSP00000238892
MVCEKCEKKLGTVITPDTWKDGARNTTESGGRKLNENKALTSKKARFDPYGKNKFSTCRICKSSVHQPGSHYCQGCAYKKGICAMCGKKVLDTKNYKQTSV

SEQ ID NO: 26811 - protein, 500 aa, Homo sapiens
  ENSP00000262207
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLWEHGPASLLPSIGQNLGAHWGRYRPPTFHVQSWYDEVKDFSYPYEHECNPYCPFRCSGPVCTHYTQVVWATSNRIGCAINLCHNMNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 26812 - protein, 105 aa, Homo sapiens
  ENSP00000430504
MKCTAREWLRVTTVLFMARAIPAMVVPNATLLEKLLEKYMDEDGEWWIAKQRGKRAITDNDMQSILDLHNKLRSQVYPTASNMEYMTWDVELERSAESWAESCLW

SEQ ID NO: 26813 - protein, 312 aa, Homo sapiens
  ENSP00000430105
MNIWGQIWPKAVYLVCNYSPKGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 26814 - protein, 314 aa, Homo sapiens
  ENSP00000429746
MNMNATHIVHSGVLALYVHIIHRGNWWGHAPYKHGRPCSACPPSFGGGCRENLCYKEGSDRYYPPREEETNEIERQQSQVHDTHVRTRSDDSSRNEVISAQQMSQIVSCEVRLRDQCKGTTCNRYECPAGCLDSKAKVIGSVHYEMQSSICRAAIHYGIIDNDGGWVDITRQGRKHYFIKSNRNGIQTIGKYQSANSFTVSKVTVQAVTCETTVEQLCPFHKPASHCPRVYCPRNCMQANPHYARVIGTRVYSDLSSICRAAVHAGVVRNHGGYVDVMPVDKRKTYIASFQNGIFSESLQNPPGGKAFRVFAVV

SEQ ID NO: 26815 - protein, 497 aa, Homo sapiens
  ENSP00000262424
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 26816 - protein, 18 aa, Homo sapiens
  ENSP00000456554
MSCVLGGVIPLGLLFLVC

SEQ ID NO: 26817 - protein, 496 aa, Homo sapiens
  ENSP00000457183
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYRETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 26818 - protein, 449 aa, Homo sapiens
  ENSP00000457655
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADVSRMHFQQLSRKAC

SEQ ID NO: 26819 - protein, 120 aa, Homo sapiens
  ENSP00000454858
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGR

SEQ ID NO: 26820 - protein, 209 aa, Homo sapiens
  ENSP00000456952
MCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHG

SEQ ID NO: 26821 - protein, 111 aa, Homo sapiens
  ENSP00000457259
MCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPR

SEQ ID NO: 26822 - protein, 43 aa, Homo sapiens
  ENSP00000463171
  MOD_RES (1)..(1): Any amino acid
XKTAVHAGVISNESGGDVDVMPVDKKKTYVGSLRNGVQSERNM

SEQ ID NO: 26823 - protein, 422 aa, Homo sapiens
  ENSP00000376188
MPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 26824 - protein, 173 aa, Homo sapiens
  ENSP00000470625
  MOD_RES (1)..(1): Any amino acid
XQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWKRPGPGGGACEPRGGEPSSGPVRR

SEQ ID NO: 26825 - protein, 524 aa, Homo sapiens
  ENSP00000408445
YALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLETPMNASSSHSCALETSPYVSTPMEATGAGPTRSAVGATSPTRMAQPAWGLSASHRAPAPPPPPLLLPLPLLLPLLELPLLHRSS

SEQ ID NO: 26826 - protein, 661 aa, Homo sapiens
  ENSP00000359629
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVGTLGQSPGPRPTTPTAAAATAAAAAAAGAATAAPVLVDGDLNLGSVVKESCEPSC

SEQ ID NO: 26827 - protein, 79 aa, Homo sapiens
  ENSP00000404549
  MOD_RES (1)..(1): Any amino acid
XDEDTLQDPAPLETPMNASSSHSCALETSPYVSTPMEATGAGPTRSAVGATSPTRMAQPAWKEPCYLVSAISLENRMLL

SEQ ID NO: 26828 - protein, 637 aa, Homo sapiens
  ENSP00000310810
MSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 26829 - protein, 645 aa, Homo sapiens
  ENSP00000359623
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVAQVAFLGGYSSAASRISEPLSRASYLSLGLGLCLQLYAL

SEQ ID NO: 26830 - protein, 586 aa, Homo sapiens
  ENSP00000008527
MGVNAVHWFRKGLRLHDNPALKECIQGADTIRCVYILDPWFAGSSNVGINRWRFLLQCLEDLDANLRKLNSRLFVIRGQPADVFPRLFKEWNITKLSIEYDSEPFGKERDAAIKKLATEAGVEVIVRISHTLYDLDKIIELNGGQPPLTYKRFQTLISKMEPLEIPVETITSEVIEKCTTPLSDDHDEKYGVPSLEELGFDTDGLSSAVWPGGETEALTRLERHLERKAWVANFERPRMNANSLLASPTGLSPYLRFGCLSCRLFYFKLTDLYKKVKKNSSPPLSLYGQLLWREFFYTAATNNPRFDKMEGNPICVQIPWDKNPEALAKWAEGRTGFPWIDAIMTQLRQEGWIHHLARHAVACFLTRGDLWISWEEGMKVFEELLLDADWSINAGSWMWLSCSSFFQQFFHCYCPVGFGRRTDPNGDYIRRYLPVLRGFPAKYIYDPWNAPEGIQKVAKCLIGVNYPKPMVNHAEASRLNIERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 26831 - protein, 106 aa, Homo sapiens
  ENSP00000447738
IERMKQIYQQLSRYRGLGLLASVPSNPNGNGGFMGYSAENIPGCSSSGSCSQGSGILHYAHGDSQQTHLLKQGRSSMGTGLSGGKRPSQEEDTQSIGPKVQRQSTN

SEQ ID NO: 26832 - protein, 175 aa, Homo sapiens
  ENSP00000436051
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 26833 - protein, 106 aa, Homo sapiens
  ENSP00000432454
  MOD_RES (1)..(1): Any amino acid
XGPANIDLNLWEIPLNISMPQGLKNNEVLDCFRLLRFSLDEHGFISREFHRKYRIPADVDPLTITSSLSSDGVLTVNGPRKQVSGPERTIPITREEKPAVTAAPKK

SEQ ID NO: 26834 - protein, 108 aa, Homo sapiens
  ENSP00000435046
MRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 26835 - protein, 108 aa, Homo sapiens; identical to SEQ ID NO: 26834
  ENSP00000435411

SEQ ID NO: 26836 - protein, 175 aa, Homo sapiens; identical to SEQ ID NO: 26832
  ENSP00000433560

SEQ ID NO: 26837 - protein, 175 aa, Homo sapiens; identical to SEQ ID NO: 26832
  ENSP00000437149

SEQ ID NO: 26838 - protein, 175 aa, Homo sapiens; identical to SEQ ID NO: 26832
  ENSP00000227251

SEQ ID NO: 26839 - protein, 175 aa, Homo sapiens; identical to SEQ ID NO: 26832
  ENSP00000434247

SEQ ID NO: 26840 - protein, 108 aa, Homo sapiens; identical to SEQ ID NO: 26834
  ENSP00000435960

SEQ ID NO: 26841 - protein, 174 aa, Homo sapiens
  ENSP00000436089
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPK

SEQ ID NO: 26842 - protein, 106 aa, Homo sapiens
  ENSP00000434793
MRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAP

SEQ ID NO: 26843 - protein, 129 aa, Homo sapiens
  ENSP00000431754
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVD

SEQ ID NO: 26844 - protein, 155 aa, Homo sapiens
  ENSP00000434269
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQVCSLFFCFLLIHSVHTVIVQVVLSALEAGYIPVPSHNSRDQGLQINV

SEQ ID NO: 26845 - protein, 77 aa, Homo sapiens
  ENSP00000432182
MDIAIHHPWIRRPFFPFHSPSRLFDQFFGEHLLESDLFPTSTSLSPFYLRPPSFLRAPSWFDTGLSEMRLEKDRFSV

SEQ ID NO: 26846 - protein, 68 aa, Homo sapiens
  ENSP00000435931
MDIAIHHPWIRRPFFPFHSPSRLFDQFFGEHLLESDLFPTSTSLSPFYLRPPSFLRAPSWFDTGLSEM

SEQ ID NO: 26847 - protein, 175 aa, Homo sapiens; identical to SEQ ID NO: 26832
  ENSP00000483554

SEQ ID NO: 26848 - protein, 197 aa, Homo sapiens
  ENSP00000375946
MSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYPSLPSMGWASKDVGSLKVSSGAWVAYQYPGYRGYQYVLERDRHSGEFCTYGELGTQAHTGQLQSIRRVQH

SEQ ID NO: 26849 - protein, 197 aa, Homo sapiens; identical to SEQ ID NO: 26848
  ENSP00000295728

SEQ ID NO: 26850 - protein, 128 aa, Homo sapiens
  ENSP00000395120
MSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYP

SEQ ID NO: 26851 - protein, 2970 aa, Homo sapiens
  ENSP00000374273
MSSGRRRGSAPWHSFSRFFAPRSPSRDKEEEEEERPGTSPPPAPGRSAASVENEPMSTSQKKENVLSSEAVKIRQSEDKRNHAEKPVTLPVQEDPKKAYDLSSSTSDTKIGESDRQPKESFFQFLGNLFNISGKSSLGEAKQSSFKDDQDKTEKDLQNPSDHHEDGIKREREIFSGSLRTQTHPTEEQDSNSSELSDAFSLDTTQDSDQETTNLLKQIDGKPEKPSVTYATYRGPRHIGKYLKQQTGLATVNTLDRENESSDSSTNRHIDPGSEIEAGVLPLLLSASTDSSMKGNLLEGPLEDSDCSKTSFNKENSLTNNPELQNIASSNNLLNKNAWGSIERNRSSPSSVTNSSYDGESDSQHHLSCEPVSQTNRNLVCSALLTGSNHRKVPCSPDFQRVTTTENTIKENSTVMSNRTLVQREELVEPQGPAISDFSCSKSDGSDTTEQESTNLPSPNKSIRHEHLQLPESECSDKQTIDSSSKQAATHTNIIALQRHAVTDTEFVNEGKRLSAQDSQKNVAVREIRRETESASAGESIASSHVKAPEDKIESLPKDTDQYFETKAKKLDFRSHDKIPHIRMNKKDLASLNYISESAVVASLGNENAPELKFELNRSHISETPLDSESPQQAEVSPDAKTSLSLDCKKLNFSISPPTFVSGVGMLSKLDIPDLMNEGSPVPIETGNVNIVGISYQPRKCKEENVKNHVEAAGRKSPPPSFCLEYTSAIFEFKEVLSNSEKCQVLPGSEASGPHLTGLELLSFDSGNLSKDCSSILSQDPNRVELVSSNTKANMSIIEKSDSLSLEAKTANIVSKAEIDGQNNVLVESHSGRGKTISLSKVSLSKVEPRNISQDKMSSFPLKITHVPEKPILSELTFLEVEQGKRFQSINHNEIGEKCSDAGLKENCQAELSPAASKYEDKPEPEVDALGSPPALLKSNISWILPPIHDEKISRQMAQNCEAHTCVFHQSLDICGTKKISGHSEMAELSLTNISPKFQETGSMKVNSPFLDSDSSLEKNSSASEDSSFLKVPSVLKLEKKSSSYRKKENIHFLNGGIDSVSSSSSYPEEVSMIVNSHKPQNNLDSIQVTKDLTHEGTSVTNLLYPTTSYLEFETSVSIGTEVTPFQEHFGIYTGKISIDFPTAAQFDNLVEAETGAVAGPAASVNSSGQQCSEASAEHIEARRRAHDQLLDLKSSLLKKADTLIGEIFNSVREELKFKHTVSTCQEHIAIEGIMNLGTLKEDISEKNPSEVTLTEIQQTEGLEEQGMENMSEVKEKPCVSPTVGEKNLLVDPNSMNVSCLLEDKARELVNEIIYVAQEKLRNDTFEDTEDTWDSELQANTSKILNSDSVKPHDVVREFLVSEQPVNQSTQISENKVLNEFFSLSNLASGTESIKGGEIVLYQKSLFSGNGSGLSDSINLQESDTVLLAEDMSHKRLDDRVKTHLFRSEDCNETMEIENVDNNKTETEDRRTLVLNFKWPPLVNDDIHAPGTSKSSLSDSLVCISEKNLPGHSKNTPLAMSDVGKVHKKDNEINIGKIELIPSMLETGKTNKKDAELNILKYEAVPPMIEMGRIHKMDAELNVTKTEPKANVFKMGEVYQMDAESCIEKTEGSAVILGMEKAYKMKDTEGDIGKIEVIPMMPEVKNIHQKDAEGDIVKTEMTPVTVDMENIYQTHAEGDIGKTGTIALSEVENIHQKGGEGISEKAEVIPVTLAMENTYQKDAEGDIGKAEVMPVRLEMENTYPKDTERDGGKTEVMPLALEVVNTYQKNAKGFTGNTEGSVLKMEATYRKTAEEVIKNTEIVPCVLKVKEAHETAPAPLEMEKACKRDVKETIGATVSTPSVIEMEKISPEDRGENIGKHKVLPAVVDIEKIHGTGLELTTKQGEAMLPAFESKTPQEYAEGSVEETKEEPTEIKEGLIAHENRLPTYFRGYESPTLSKDYEGYPAPAMPDFQPGDTTVRLDKRMSLTAIYDKRRETDYSDKGYNLAFVSQDEQENSSFTILYEEPLQEEDKYASAEARQTQSVLFHDTSADSMPVLACERSESRTDLVHHFEKGTKLGETFDSDSSEMFLSVEAKRYKIYPLALSPIYEDDSSQEDILSSEVSPGHHGPRKSRDSENQSSSVLSLLQSVSERLKMNFDEDDREAADEEEEEEEAAVLHKGDLRAGSGERVTFQLPDPSITFYPDDQESVGISKNSYVMPNEPTTSNLQVGLWPEKTSFLQKSDLTSKLHSSLKSAYHQYLQTSQSHSSEKGARFGGIFQEPVSKYFRVQDSPGRLSPFIENVDKQTLRCNPRPGKMVIYDLHESTYKQEVYCNIPDATSWSFPNGVLIKVVRGCWILYEKPHFRGQKCVLEEGEKVLNRDWILQNRRHPQRNFILGSLKRVLKDCSIPEIELFPQSDPACCPVYIQRAVPNLEELNISKSVSFTVKSGVWLAYPDINFKGQATVLEEDHGLFEISTAEMKSLHPLQMGGLKVEMPMNLKVIIYEKPHFHGQAKEFSEHIDSVPNFLKNNGDFHRIGSIRVIGGVWVAYEKEHFKGQQFLLEEGDFEDSNACGALSSPILSFRYLQANFIESSVTLFESDLESGKFIDITNQEISDLEEIGFGSKTRSIHVKSGVWVAYQQKFFCGEQYILEKGKYKCFFDWGGSNNIIMSIRPIQLEPLGINEPPHLLKAFSKPGFQGECIDFTEETSDLTSLMPCSFKVLRGCWLLYYQEDMFVNHCVLEEGLYADLTSCGCPASKVKSLKPIDYVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGKNTQIWYYCRGLFKSKASDTCLDVIGGRDTPGAKVALWTEHGQFRQKWRLNKNGTISSYLSDQLVLDVKGGNYCDKTHVIVNQPLEGEETQKWDIEIL

SEQ ID NO: 26852 - protein, 131 aa, Homo sapiens
  ENSP00000418420
MNKKKVFEEPSISLFALEHCEGRELHLEEAVNSVLNKDLHFYTQSVWVKSGLWIAYEGSNFLGRQILLRPNEIPNWTAFSRWKTIGSLRPMKQPAVYIRIKNRAQGEYLTVTGSLADTRATSVCISPYSGK
